US012258418B2

(12) United States Patent
Yin et al.

(10) Patent No.: US 12,258,418 B2
(45) Date of Patent: Mar. 25, 2025

(54) CLAUDIN18.2 BINDING MOIETIES AND USES THEREOF

(71) Applicants: Nanjing GenScript Biotech Co., Ltd., Nanjing (CN); Nanjing Legend Biotech Co., Ltd., Nanjing (CN)

(72) Inventors: Liusong Yin, Nanjing (CN); Tielin Zhou, Singapore (SG); Zhuo Fang, Nanjing (CN); Yong Liu, Nanjing (CN); Qiuchuan Zhuang, Nanjing (CN); Bo Wu, Nanjing (CN); Xiaohu Fan, Nanjing (CN); Qingshan Zhang, Nanjing (CN); Dan Zhao, Nanjing (CN); Jie Mao, Nanjing (CN)

(73) Assignees: Nanjing GenScript Biotech Co., Ltd., Nanjing (CN); Nanjing Legend Biotech Co., Ltd, Nanjing (CN)

( * ) Notice: Subject to any disclaimer, the term of this patent is extended or adjusted under 35 U.S.C. 154(b) by 887 days.

(21) Appl. No.: 17/419,203

(22) PCT Filed: Dec. 27, 2019

(86) PCT No.: PCT/CN2019/129017
§ 371 (c)(1),
(2) Date: Jun. 28, 2021

(87) PCT Pub. No.: WO2020/135674
PCT Pub. Date: Jul. 2, 2020

(65) Prior Publication Data
US 2022/0073643 A1 Mar. 10, 2022

(30) Foreign Application Priority Data

Dec. 28, 2018 (WO) ................ PCT/CN2018/125052
Jul. 12, 2019 (WO) ................ PCT/CN2019/095827

(51) Int. Cl.
*C07K 16/30* (2006.01)
*A61K 39/00* (2006.01)
*A61P 35/00* (2006.01)

(52) U.S. Cl.
CPC .......... *C07K 16/3046* (2013.01); *A61P 35/00* (2018.01); *A61K 2039/505* (2013.01); *C07K 2317/24* (2013.01); *C07K 2317/622* (2013.01); *C07K 2317/732* (2013.01); *C07K 2317/734* (2013.01); *C07K 2319/02* (2013.01); *C07K 2319/03* (2013.01); *C07K 2319/33* (2013.01)

(58) Field of Classification Search
None
See application file for complete search history.

(56) References Cited

U.S. PATENT DOCUMENTS

| | | | |
|---|---|---|---|
| 2009/0169547 A1* | 7/2009 | Sahin | A61P 35/04 424/139.1 |
| 2018/0117174 A1 | 5/2018 | Sahin et al. | |
| 2018/0326059 A1* | 11/2018 | Sahin | A61P 35/00 |
| 2020/0399364 A1* | 12/2020 | Wang | C07K 16/28 |

FOREIGN PATENT DOCUMENTS

| | | |
|---|---|---|
| CN | 103509114 A | 1/2014 |
| CN | 104379166 A | 2/2015 |
| CN | 105073777 A | 11/2015 |
| EP | 1790664 A1 | 5/2007 |
| EP | 3401334 A1 | 11/2018 |
| EP | 3483182 A1 | 5/2019 |
| JP | 2009/517354 A | 4/2009 |
| JP | 2016/510721 A | 4/2016 |
| JP | 2018/513146 A | 5/2018 |
| WO | WO 2007/059997 A1 | 5/2007 |
| WO | WO 2013174403 A1 | 11/2013 |
| WO | WO 2014/127906 A1 | 8/2014 |
| WO | WO 2014127785 A1 | 8/2014 |
| WO | WO 2016/166122 A1 | 4/2016 |
| WO | WO 2018/006882 A1 | 1/2018 |

OTHER PUBLICATIONS

Lamminmaki et al. "Crystal structure of a recombinant anti-estradiol Fab fragment in complex with 17beta-estradiol", JBC 2001, 276:36687-36694 (Year: 2001).*
Rudikoff et al. "Single amino acid altering antigen-binding specificity", Proc Natl Acad Sci USA 1982 vol. 79 p. 1979 (Year: 1982).*
MacCallum et al. "Antibody-antigen Interactions: Contact Analysis and Binding Site Topography", J. Mol. Biol. (1996) 262, 732-745 (Year: 1996).*
Pascalis et al. "Grafting of "Abbreviated" Complementarity-Determining Regions Containing Specificity-Determining Residues Essential for Ligand Contact to Engineer a Less Immunogenic Humanized Monoclonal Antibody", The Journal of Immunology (2002) 169, 3076-3084 (Year: 2002).*
Casset et al. "A peptide mimetic of an anti-CD4 monoclonal antibody by rational design", BBRC 2003, 307:198-205 (Year: 2003).*
Vajdos et al. "Comprehensive functional maps of the antigen-binding site of an anti-ErbB2 antibody obtained with shotgun scanning mutagenesis", J. Mol. Biol. (2002) 320, 415-428 (Year: 2002).*

(Continued)

*Primary Examiner* — Amy E Juedes
*Assistant Examiner* — Peter Johansen
(74) *Attorney, Agent, or Firm* — Klarquist Sparkman, LLP

(57) ABSTRACT

Described herein are binding moieties, such as antibodies, that specifically bind Claudin18.2, and chimeric antigen receptors comprising such binding moieties. Further provided are engineered immune cells (such as T cells) comprising anti-Claudin 18.2 chimeric antigen receptors. Also disclosed are methods of treating Claudin18.2-expressing tumor or cancers using the binding moieties, chimeric antigen receptors and engineered immune cells.

20 Claims, 24 Drawing Sheets

Specification includes a Sequence Listing.

(56) References Cited

OTHER PUBLICATIONS

Chen et al. "Selection and analysis of an optimized anti-VEGF antibody: crystal structure of an affinity-matured Fab in complex with antigen", J. Mol. Bio. (1999) 293, 865-881 (Year: 1999).*
Wu et al. "Humanization of a murine monoclonal antibody by simultaneous optimization of framework and CDR residues", J. Mol. Biol. (1999) 294, 151-162 (Year: 1999).*
Padlan et al. "Structure of an antibody-antigen complex: crystal structure of the HyHEL-10 Fab-lysozyme complex", PNAS 1989, 86: 5938-5942 (Year: 1989).*
International Search Report and Written Opinion for PCT/CN2019/129017 mailed on Mar. 26, 2020 (12 pages).
Database STN Registry [Online] Dec. 16, 2013, Anonymous: "Immunoglobulin G1, anti-(human claudin-18.2) (human-Mus musculus monoclonal IMAB362 heavy chain), disulfide with human-Mus musculus monoclonal IMAB362 kappa.-chain, dimer (CA Index Name)", XP55978630, Database accession No. 1496553-00-4 (4 pages).
European Patent Office Extended European Search Report mailed on Nov. 16, 2022 in EPC Application No. 19906510.3 (36 pages).
Singh et al., "Anti-claudin 18.2 antibody as new targeted therapy for advanced gastric cancer," *Journal of Hematology & Oncology*, vol. 10, p. 1-5 (2017).
Woll et al., "Claudin 18.2 is a target for IMAB362 antibody in pancreatic neoplasms," *International Journal of Cancer*, vol. 134 (3), p. 731-739 (2013).
Supplemental Partial EP Search Report for Application No. EP 19906510, dated Aug. 3, 2022 (17 pages).

* cited by examiner

CLAUDIN18.2 BINDING MOIETIES AND USES THEREOF

This is the U.S. National Stage of International Application No. PCT/CN2019/129017 filed Dec. 27, 2019, which was published in English under PCT Article 21 (2), and which in turn claims the benefit of International Patent Application No. PCT/CN2018/125052 filed on Dec. 28, 2018, and of International Patent Application No. PCT/CN2019/095827 filed on Jul. 12, 2019, the contents of which are incorporated herein by reference in their entirety.

SEQUENCE LISTING

The nucleic and amino acid sequences listed in the accompanying sequence listing are shown using standard letter abbreviations for nucleotide bases, and three letter code for amino acids, as defined in 37 C.F.R. 1.822. The Sequence Listing is submitted as an ASCII text file, created on Jun. 28, 2021, 604 KB, which is incorporated by reference herein.

FIELD OF THE INVENTION

The present disclosure relates to the fields of molecular biology, cell biology, and cancer biology, especially relates to antibodies, chimeric antigen receptors and engineered immune cells that target Claudin18.2, and methods of use thereof.

BACKGROUND OF THE INVENTION

Claudins are a family of cell-surface proteins that establish a paracellular barrier and control the flow of molecules between cells, playing critical roles in cell signaling and epithelial cell polarity maintaining (Singh et al., (2010) *J Oncol* 2010: 541957). Each claudin molecular has four transmembrane segments with two extracellular loops, and N- and C-termini located in the cytoplasm. In humans, 24 claudin family members have been discovered and described. These members are expressed on different tissues, and their altered functions have been linked to the formation of cancers. For example, Claudin 1, Claudin 18 and Claudin 10 expression level changes have been associated with colon cancer, gastric cancer and hepatocellular carcinoma, respectively, and claudins have thus become promising targets for therapeutic strategies (Swisshelm et al., (2005) *Adv Drug Deliv Rev* 57(6): 919-928).

Claudin18 (CLDN18) has two splice variants, Claudin18.1 (CLDN18.1) and Claudin18.2 (CLDN18.2), which differ in the N-terminal portion. There is no detectable expression of Claudin18.2 in normal tissues with exception of stomach where Claudin18.2 is expressed exclusively on short-lived differentiated gastric epithelial cells. It, however, is maintained in the course of malignant transformation and thus frequently displayed on the surface of human gastric cancer cells. Moreover, this protein is ectopically activated at significant levels in esophageal, pancreatic and lung adenocarcinomas (Niimi et al., (2001) *Mol Cell Biol* 21(21): 7380-7390; Tanaka et al. (2011) *J Histochem Cytochem* 59(10): 942-952; Micke et al., (2014) *Int J Cancer* 135(9): 2206-2214; Shimobaba et al. (2016) *Biochim Biophys Acta* 1863(6 Pt A): 1170-1178; Singh et al., (2017) *J Hematol Oncol* 10(1): 105; Tokumitsu et al., (2017) *Cytopathology* 28(2): 116-121).

Claudin18.2's exposed extracellular loops and restrictive expression pattern make it a promising target for cancer immunotherapy. Anti-Claudin18.2 antibodies and CARs have been developed and studied for years. For example, IMAB362 (Claudiximab, Zolbetuximab), a chimeric monoclonal IgG1 antibody, is studied in numerous clinical trials for the treatment of patients with advanced gastroesophageal cancers (Sahin et al., (2017) *Journal of Hematology & Oncology* 10: 105). CARsgen's anti-Claudin18.2 chimeric antigen receptor T cell (CAR-T cell) therapy has entered into clinical trials too.

Different from the antibody therapies, CAR-T cell therapies bypass the need for active immunization and therefore have potential efficacy in immunologically compromised cancer patients. The new generation CARs comprise an extracellular immunoglobulin-derived heavy and light chains, a T-cell activating domain (typically including the zeta chain of the CD3 complex), and one or more chimeric domains from co-stimulatory proteins. They recognize tumor antigens independently of HLA, and trigger extensive proliferation of CAR-T cells upon antigen binding (Carl H. June, (2018) *N Engl J Med*, 379:64-73).

Although FDA has recently approved CD19 CAR-T cells for treatment of B-cell cancers, and there are hundreds of ongoing clinical trails globally involving CAR-T, the majority target blood cancers. Trials for solid tumors are less dominated by CAR-T, with about half of cell therapy based trials involving other platforms such as NK cells.

As a Claudin18.2 relevant solid tumor, gastric cancer is the fourth (in males) and fifth (in females) most common causes of cancer-related deaths in the developed countries, and pancreatic cancer is usually diagnosed at an advanced stage that patients have extremely poor prognosis. There remains a need in the art for additional Claudin18.2 binding moieties and CARs thereof with more desirable pharmaceutical properties.

SUMMARY OF THE INVENTION

Provided herein are Claudin18.2 binding moieties, such as anti-Claudin18.2 antibodies or antigen binding fragments thereof.

Provided herein are binding moieties that specifically bind to Claudin18.2, comprising (a) a heavy chain variable region (VH) comprising (1) a heavy chain CDR1 (VH CDR1) comprising $X_1X_2X_3X_4X_5$, wherein $X_1$ is S or N; $X_2$ is H, Y, or F; $X_3$ is N or G; $X_4$ is M, I, or L; and $X_5$ is H or N (SEQ ID NO: 174); (2) a heavy chain CDR2 (VH CDR2) comprising $X_6IX_7PGX_8GX_9X_{10}X_{11}YNX_{12}X_{13}FX_{14}X_{15}$, wherein $X_6$ is Y or W; $X_7$ is Y or F; $X_8$ is N or D; $X_9$ is G, R, or N; $X_{10}$ is T, N, or S; $X_{11}$ is K, N, or Y; $X_{12}$ is Q or E; $X_{13}$ is K or N; $X_{14}$ is T or K; and $X_{15}$ is G or A (SEQ ID NO:175); and (3) a heavy chain CDR3 (VH CDR3) comprising $X_{16}YYGNSFX_{17}X_{18}$, wherein $X_{16}$ is D or F; $X_{17}$ is A or V; and $X_{18}$ is Y or N (SEQ ID NO:176); and/or (b) a light chain variable region (VL) comprising (1) a light chain CDR1 (VL CDR1) comprising KSSQSLX$_{19}$NSGNQKNYLT, wherein $X_{19}$ is L or F (SEQ ID NO:186); (2) a light chain CDR2 (VL CDR2) comprising WAX$_{20}$TRES, wherein $X_{20}$ is S or A (SEQ ID NO:187); and (3) a light chain CDR3 (VL CDR3) comprising QNX$_{21}$X$_{22}$X$_{23}$X$_{24}$PX$_{25}$X$_{26}$, wherein $X_{21}$ is D, G, or N; $X_{22}$ is Y or F; $X_{23}$ is M, R, S, W, Y, or F; $X_{24}$ is F or Y; $X_{25}$ is F or L; and $X_{26}$ is T or P (SEQ ID NO:188).

In some embodiments, the binding moieties that specifically bind to Claudin18.2 comprise (a) a VH comprising (1) a VH CDR1 comprising SHNMH (SEQ ID NO:69); (2) a VH CDR2 comprising YIYPGNGGTNYNQKFKG (SEQ ID NO: 90); and (3) a VH CDR3 comprising DYYGNSFAY (SEQ ID NO:117) or a variant thereof comprising up to about 5 amino acid substitutions in the CDRs; and/or (b) a VL comprising (1) a VL CDR1 comprising KSSQSLLNSGNQKNYLT (SEQ ID NO:136); (2) a VL CDR2 comprising WASTRES (SEQ ID NO:143); and (3) a VL CDR3 comprising QNDYRYPFT (SEQ ID NO:151) or a variant thereof comprising up to about 5 amino acid substitutions in the CDRs.

In some embodiments, the binding moieties that specifically bind to Claudin18.2 comprise (a) a VH comprising a VH CDR1, CDR2, and CDR3 comprising (1) the amino acid sequences of SEQ ID NOs: 69, 89, and 117, respectively; (2) the amino acid sequences of SEQ ID NOs: 69, 90, and 117, respectively; (3) the amino acid sequences of SEQ ID NOs: 70, 90, and 117, respectively; (4) the amino acid sequences of SEQ ID NOs: 69, 91, and 117, respectively; (5) the amino acid sequences of SEQ ID NOs: 71, 92, and 117, respectively; (6) the amino acid sequences of SEQ ID NOs: 72, 93, and 117, respectively; (7) the amino acid sequences of SEQ ID NOs: 69, 94, and 118, respectively; (8) the amino acid sequences of SEQ ID NOs: 73, 95, and 117, respectively; (9) the amino acid sequences of SEQ ID NOs: 74, 96, and 119, respectively; (10) the amino acid sequences of SEQ ID NOs: 74, 96 and 130, respectively; (11) the amino acid sequences of SEQ ID NOs: 69, 202 and 118, respectively; (12) the amino acid sequences of SEQ ID NOs: 72, 90 and 117, respectively; or (13) the amino acid sequences of SEQ ID NOs: 69, 390 and 118, respectively, or a variant thereof comprising up to about 5 amino acid substitutions in the CDRs; and/or (b) a VL comprising a VL CDR1, CDR2, and CDR3 comprising (1) the amino acid sequences of SEQ ID NOs: 136, 143, and 150, respectively; (2) the amino acid sequences of SEQ ID NOs: 137, 143, and 151, respectively; (3) the amino acid sequences of SEQ ID NOs: 136, 143, and 152, respectively; (4) the amino acid sequences of SEQ ID NOs: 137, 143, and 153, respectively; (5) the amino acid sequences of SEQ ID NOs: 136, 143, and 154, respectively; (6) the amino acid sequences of SEQ ID NOs: 136, 143, and 155, respectively; (7) the amino acid sequences of SEQ ID NOs: 136, 143, and 156, respectively; (8) the amino acid sequences of SEQ ID NOs: 137, 143, and 157, respectively; (9) the amino acid sequences of SEQ ID NOs: 136, 144, and 158, respectively; (10) the amino acid sequences of SEQ ID NOs: 136, 143 and 455, respectively; or (11) the amino acid sequences of SEQ ID NOs: 136, 143 and 249, respectively, or a variant thereof comprising up to about 5 amino acid substitutions in the CDRs.

In some embodiments, the binding moieties that specifically bind to Claudin18.2 comprise (a) a VH comprising a VH CDR1, CDR2, and CDR3 comprising the amino acid sequences of SEQ ID NOs: 69, 89, and 117, respectively; and/or (b) a VL comprising a VL CDR1, CDR2, and CDR3 comprising the amino acid sequences of SEQ ID NOs: 136, 143, and 150, respectively.

In some embodiments, the binding moieties that specifically bind to Claudin18.2 comprise (a) a VH comprising a VH CDR1, CDR2, and CDR3 comprising the amino acid sequences of SEQ ID NOs: 69, 90, and 117, respectively; and/or (b) a VL comprising a VL CDR1, CDR2, and CDR3 comprising the amino acid sequences of SEQ ID NOs: 137, 143, and 151, respectively.

In some embodiments, the binding moieties that specifically bind to Claudin18.2 comprise (a) a VH comprising VH CDR1, CDR2, and CDR3 comprising the amino acid sequences of SEQ ID NOs: 70, 90, and 117, respectively; and/or (b) a VL comprising a VL CDR1, CDR2, and CDR3 comprising the amino acid sequences of SEQ ID NOs: 136, 143, and 152, respectively.

In some embodiments, the binding moieties that specifically bind to Claudin18.2 comprise (a) a VH comprising VH CDR1, CDR2, and CDR3 comprising the amino acid sequences of SEQ ID NOs: 69, 91, and 117, respectively; and/or (b) a VL comprising a VL CDR1, CDR2, and CDR3 comprising the amino acid sequences of SEQ ID NOs: 137, 143, and 153, respectively.

In some embodiments, the binding moieties that specifically bind to Claudin18.2 comprise (a) a VH comprising VH CDR1, CDR2, and CDR3 comprising the amino acid sequences of SEQ ID NOs: 71, 92, and 117, respectively; and/or (b) a VL comprising a VL CDR1, CDR2, and CDR3 comprising the amino acid sequences of SEQ ID NOs: 136, 143, and 154, respectively.

In some embodiments, the binding moieties that specifically bind to Claudin18.2 comprise (a) a VH comprising VH CDR1, CDR2, and CDR3 comprising the amino acid sequences of SEQ ID NOs: 72, 93, and 117, respectively; and/or (b) a VL comprising a VL CDR1, VL CDR2, and VL CDR3, comprising the amino acid sequences of SEQ ID NOs: 136, 143, and 155, respectively.

In some embodiments, the binding moieties that specifically bind to Claudin18.2 comprise (a) a VH comprising VH CDR1, CDR2, and CDR3 comprising the amino acid sequences of SEQ ID NOs: 69, 94, and 118, respectively; and/or (b) a VL comprising a VL CDR1, CDR2, and CDR3 comprising the amino acid sequences of SEQ ID NOs: 136, 143, and 156, respectively.

In some embodiments, the binding moieties that specifically bind to Claudin18.2 comprise (a) a VH comprising VH CDR1, CDR2, and CDR3 comprising the amino acid sequences of SEQ ID NOs: 73, 95, and 117, respectively and/or (b) a VL comprising a VL CDR1, CDR2, and CDR3 comprising the amino acid sequences of SEQ ID NOs: 137, 143, and 157, respectively.

In some embodiments, the binding moieties that specifically bind to Claudin18.2 comprise (a) a VH comprising VH CDR1, CDR2, and CDR3 comprising the amino acid sequences of SEQ ID NOs: 74, 96, and 119, respectively; and/or (b) a VL comprising a VL CDR1, CDR2, and CDR3 comprising the amino acid sequences of SEQ ID NOs: 136, 144, and 158, respectively.

In some embodiments, the binding moieties that specifically bind to Claudin18.2 comprise (a) a VH comprising VH CDR1, CDR2, and CDR3 comprising the amino acid sequences of SEQ ID NOs: 74, 96, and 130, respectively; and/or (b) a VL comprising a VL CDR1, CDR2, and CDR3 comprising the amino acid sequences of SEQ ID NOs: 136, 144, and 158, respectively.

In some embodiments, the binding moieties that specifically bind to Claudin18.2 comprise (a) a VH comprising VH CDR1, CDR2, and CDR3 comprising the amino acid sequences of SEQ ID NOs: 69, 202, and 118, respectively; and/or (b) a VL comprising a VL CDR1, CDR2, and CDR3 comprising the amino acid sequences of SEQ ID NOs: 136, 143, and 455, respectively.

In some embodiments, the binding moieties that specifically bind to Claudin18.2 comprise (a) a VH comprising VH CDR1, CDR2, and CDR3 comprising the amino acid sequences of SEQ ID NOs: 72, 90, and 117, respectively; and/or (b) a VL comprising a VL CDR1, CDR2, and CDR3 comprising the amino acid sequences of SEQ ID NOs: 137, 143, and 153, respectively.

In some embodiments, the binding moieties that specifically bind to Claudin18.2 comprise (a) a VH comprising VH CDR1, CDR2, and CDR3 comprising the amino acid sequences of SEQ ID NOs: 69, 390, and 118, respectively; and/or (b) a VL comprising a VL CDR1, CDR2, and CDR3 comprising the amino acid sequences of SEQ ID NOs: 136, 143, and 249, respectively.

In some embodiments, provided herein are binding moieties that specifically bind to Claudin18.2, comprising (a) a VH comprising (1) a VH CDR1 comprising $SYX_{27}X_{28}H$, wherein $X_{27}$=is N or Y; and $X_{28}$ is M or I (SEQ ID NO: 177); (2) a VH CDR2 comprising $YIX_{29}PX_{30}NGGX_{31}X_{32}YX_{33}X_{34}KFX_{35}X_{36}$, wherein $X_{29}$ is Y, S, or D; $X_{30}$ is G or F; $X_{31}$ is T or S; $X_{32}$ is N, Y, or R; $X_{33}$ is S or N; $X_{34}$ is Q or L; $X_{35}$ is K, R, or E; $X_{36}$ is G or D (SEQ ID NO:178); and (3) a VH CDR3 comprising $X_{37}RX_{38}X_{39}X_{40}Y$, wherein $X_{37}$ is G or L; $X_{38}$ is G or F; $X_{39}$ is F or L; $X_{40}$ is A or T (SEQ ID NO:179); and/or (b) a VL comprising (1) VL CDR1 comprising $KSSQSLX_{41}NX_{42}GNQX_{43}NYLX_{44}$, wherein $X_{41}$ is F or L; $X_{42}$ is T or S; $X_{43}$ is K or E; and $X_{44}$ is T or I (SEQ ID NO:189); (2) a VL CDR2 comprising $RASTRX_{45}S$, wherein $X_{45}$ is E, D, or Q (SEQ ID NO:190); and (3) a VL CDR3 comprising $QNDX_{46}SYPLT$, wherein $X_{46}$ is F or Y (SEQ ID NO:191).

In some embodiments, provided herein are binding moieties that specifically bind to Claudin18.2, comprising (a) a VH comprising (1) a VH CDR1 comprising SYNTH (SEQ ID NO:75); (2) a VH CDR2 comprising YIYPGNGGTNYNQKFKG (SEQ ID NO: 90); and (3) a VH CDR3 comprising GRGFAY (SEQ ID NO:120) or a variant thereof comprising up to about 5 amino acid substitutions in the CDRs; and/or (b) a VL comprising (1) a VL CDR1 comprising KSSQSLFNSGNQKNYLT (SEQ ID NO:137); (2) a VL CDR2 comprising RASTRES (SEQ ID NO:145); and (3) a VL CDR3 comprising QNDYSYPLT (SEQ ID NO:160) or a variant thereof comprising up to about 5 amino acid substitutions in the CDRs.

In some embodiments, provided herein are binding moieties that specifically bind to Claudin18.2, comprising (a) VH comprising a VH CDR1, VH CDR2, and VH CDR3, comprising (1) the amino acid sequences of SEQ ID NOs: 70, 97, and 120, respectively; (2) the amino acid sequences of SEQ ID NOs: 70, 98, and 120, respectively; (3) the amino acid sequences of SEQ ID NOs: 75, 99, and 120, respectively; (4) the amino acid sequences of SEQ ID NOs: 75, 100, and 120, respectively; (5) the amino acid sequences of SEQ ID NOs: 70, 90, and 121, respectively; (6) the amino acid sequences of SEQ ID NOs: 76, 101, and 122, respectively; (7) the amino acid sequences of SEQ ID NOs: 76, 101, and 123, respectively; (8) the amino acid sequences of SEQ ID NOs: 70, 201, and 120, respectively; or (9) the amino acid sequences of SEQ ID NOs: 70, 202, and 120, respectively; or a variant thereof comprising up to about 5 amino acid substitutions in the CDRs; and/or (b) a VL comprising a VL CDR1, VL CDR2, and VL CDR3, comprising (1) the amino acid sequences of SEQ ID NOs: 138, 145, and 159, respectively; (2) the amino acid sequences of SEQ ID NOs: 136, 145, and 160, respectively; (3) the amino acid sequences of SEQ ID NOs: 139, 146, and 160, respectively; (4) the amino acid sequences of SEQ ID NOs: 137, 145, and 160, respectively; (5) the amino acid sequences of SEQ ID NOs: 140, 147, and 160, respectively; or (6) the amino acid sequences of SEQ ID NOs: 136, 147, and 160, respectively; or a variant thereof comprising up to about 5 amino acid substitutions in the CDRs.

In some embodiments, provided herein are binding moieties that specifically bind to Claudin18.2, comprising (a) a VH comprising a VH CDR1, CDR2, and CDR3 comprising the amino acid sequences of SEQ ID NOs: 70, 97, and 120, respectively; and/or (b) a VL comprising a VL CDR1, CDR2, and CDR3 comprising the amino acid sequences of SEQ ID NOs: 138, 145, and 159, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 70, 98, and 120, respectively; and/or (b) a VL comprising a VL CDR1, CDR2, and CDR3 comprising the amino acid sequences of SEQ ID NOs: 136, 145, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 75, 99, and 120; and/or (b) a VL comprising a VL CDR1, CDR2, and CDR3 comprising the amino acid sequences of SEQ ID NOs: 139, 146, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 75, 100, and 120, respectively; and/or (b) a VL comprising a VL CDR1, CDR2, and CDR3 comprising the amino acid sequences of SEQ ID NOs: 139, 146, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 70, 90, and 121, respectively; and/or (b) a VL comprising a VL CDR1, CDR2, and CDR3 comprising the amino acid sequences of SEQ ID NOs: 137, 145, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 76, 101, and 122, respectively; and/or (b) a VL comprising a VL CDR1, CDR2, and CDR3 comprising the amino acid sequences of SEQ ID NOs: 140, 147, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 76, 101, and 123, respectively; and/or (b) a VL comprising a VL CDR1, CDR2, and CDR3 comprising the amino acid sequences of SEQ ID NOs: 136, 147, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 70, 201, and 120, respectively; and/or (b) a VL comprising a VL CDR1, CDR2, and CDR3 comprising the amino acid sequences of SEQ ID NOs: 137, 145, and 160, respectively.

In some embodiments, provided herein are binding moieties that specifically bind to Claudin18.2, comprising (a) a VH comprising VH CDR1, CDR2, and CDR3 comprising the amino acid sequences of SEQ ID NOs: 70, 202, and 120, respectively; and/or (b) a VL comprising a VL CDR1, CDR2, and CDR3 comprising the amino acid sequences of SEQ ID NOs: 136, 145, and 160, respectively.

In some embodiments, provided herein are binding moieties that specifically bind to Claudin18.2, comprising (a) a VH comprising (1) a VH CDR1 comprising $X_{47}YGVX_{48}$, wherein $X_{47}$ is T, S, or R, and $X_{48}$, H or S (SEQ ID NO:

180); (2) a VH CDR2 comprising VIWX$_{49}$X$_{50}$GX$_{51}$TX$_{52}$YX$_{53}$X$_{54}$X$_{55}$X$_{56}$X$_{57}$S, wherein X$_{49}$ is A, G, or S; X$_{50}$ is G or D; X$_{51}$ is S or N; X$_{52}$ is N or D; X$_{53}$ is N or H; X$_{54}$ is S or A; X$_{55}$ is A or T; X$_{56}$ is L or F; and X$_{57}$ is M or I (SEQ ID NO:181); and (3) a VH CDR3 comprising X$_{58}$X$_{59}$X$_{60}$X$_{61}$GNX$_{62}$X$_{63}$DY, wherein X$_{58}$ is A or null; X$_{59}$ is A, G, or V; X$_{60}$ is Y or R; X$_{61}$ is Y, F or null; X$_{62}$ is A, G, or S; and X$_{63}$ is L, F, or M (SEQ ID NO:182); and/or (b) a VL comprising (1) a VL CDR1 comprising KSSQX$_{64}$LLNSGNQKX$_{65}$YLT, wherein X$_{64}$ is T or S; and X$_{65}$ is N or S (SEQ ID NO:192); (2) a VL CDR2 comprising WASTX$_{66}$X$_{67}$S, wherein X$_{66}$ is G or R; and X$_{67}$ is E or D (SEQ ID NO:193); and (3) a VL CDR3 comprising QNX$_{68}$YX$_{69}$X$_{70}$PX$_{71}$T, wherein X$_{68}$ is A, D, N, or V; X$_{69}$ is F, S, or I; and X$_{70}$ is Y or F; and X$_{71}$ is F or L (SEQ ID NO:194).

In some embodiments, the provided herein are binding moieties that specifically bind to Claudin18.2, comprising (a) a VH comprising (1) a VH CDR1 comprising SYGVS (SEQ ID NO:78); (2) a VH CDR2 comprising VIWAGG-STNYHSALMS (SEQ ID NO: 197); and (3) a VH CDR3 comprising AAYYGNALDY (SEQ ID NO:198) or a variant thereof comprising up to about 5 amino acid substitutions in the CDRs; and/or (b) a VL comprising (1) a VL CDR1 comprising KSSQSLLNSGNQKNYLT (SEQ ID NO:136); (2) a VL CDR2 comprising WASTRES (SEQ ID NO:143); and (3) a VL CDR3 comprising QNAYFYPFT (SEQ ID NO:161) or a variant thereof comprising up to about 5 amino acid substitutions in the CDRs.

In some embodiments, the provided herein are binding moieties that specifically bind to Claudin18.2, comprising (a) a VH comprising a VH CDR1, VH CDR2, and VH CDR3, comprising (1) the amino acid sequences of SEQ ID NOs: 77, 102, and 124, respectively; (2) the amino acid sequences of SEQ ID NOs: 78, 103, and 125, respectively; (3) the amino acid sequences of SEQ ID NOs: 79, 104, and 126, respectively; (4) the amino acid sequences of SEQ ID NOs: 78, 105, and 127, respectively; or (5) the amino acid sequences of SEQ ID NOs: 209, 103 and 125, respectively, or a variant thereof comprising up to about 5 amino acid substitutions in the CDRs; and/or (b) a VL comprising a VL CDR1, VL CDR2, and VL CDR3, comprising (1) the amino acid sequences of SEQ ID NOs: 141, 148, and 161, respectively; (2) the amino acid sequences of SEQ ID NOs: 136, 143, and 162, respectively; (3) the amino acid sequences of SEQ ID NOs: 136, 149, and 163, respectively; or (4) the amino acid sequences of SEQ ID NOs: 142, 143, and 164, respectively; or a variant thereof comprising up to about 5 amino acid substitutions in the CDRs.

In some embodiments, provided herein are binding moieties that specifically bind to Claudin18.2, comprising (a) a VH comprising a VH CDR1, VH CDR2, and VH CDR3, comprising the amino acid sequences of SEQ ID NOs: 77, 102, and 124, respectively; and/or (b) a VL comprising a VL CDR1, CDR2, and CDR3 comprising the amino acid sequences of SEQ ID NOs: 141, 148, and 161, respectively.

In some embodiments, provided herein are binding moieties that specifically bind to Claudin18.2, comprising (a) a VH comprising VH CDR1, VH CDR2, and VH CDR3, comprising the amino acid sequences of SEQ ID NOs: 78, 103, and 125, respectively; and/or (b) a VL comprising a VL CDR1, CDR2, and CDR3 comprising the amino acid sequences of SEQ ID NOs: 136, 143, and 162, respectively.

In some embodiments, provided herein are binding moieties that specifically bind to Claudin18.2, comprising (a) a VH comprising VH CDR1, VH CDR2, and VH CDR3, comprising the amino acid sequences of SEQ ID NOs: 79, 104, and 126, respectively; and/or (b) a VL comprising a VL CDR1, CDR2, and CDR3 comprising the amino acid sequences of SEQ ID NOs: 136, 149, and 163, respectively.

In some embodiments, provided herein are binding moieties that specifically bind to Claudin18.2, comprising (a) a VH comprising VH CDR1, VH CDR2, and VH CDR3, comprising the amino acid sequences of SEQ ID NOs: 78, 105, and 127, respectively; and/or (b) a VL comprising a VL CDR1, CDR2, and CDR3 comprising the amino acid sequences of SEQ ID NOs: 142, 143, and 164, respectively.

In some embodiments, provided herein are binding moieties that specifically bind to Claudin18.2, comprising (a) a VH comprising VH CDR1, VH CDR2, and VH CDR3, comprising the amino acid sequences of SEQ ID NOs: 209, 103 and 125, respectively; and/or (b) a VL comprising a VL CDR1, CDR2, and CDR3 comprising the amino acid sequences of SEQ ID NOs: 136, 143, and 162, respectively.

In some embodiments, provided herein are binding moieties that specifically bind to Claudin18.2, comprising (a) a VH comprising (1) a VH CDR1 comprising X$_{72}$X$_{73}$GMH, wherein X$_{72}$ is S, G, or T; and X$_{73}$ is F or S (SEQ ID NO: 183); (2) a VH CDR2 comprising YIX$_{74}$X$_{75}$GSX$_{76}$X$_{77}$IX$_{78}$YAX$_{79}$X$_{80}$X$_{81}$X$_{82}$G, wherein X$_{74}$ is S or N; X$_{75}$ is S, G, or T; X$_{76}$ is S, R, T, or N; X$_{77}$ is T, or P; X$_{78}$ is Y or F; X$_{79}$ is D or H; X$_{80}$ is T or S; X$_{81}$ is V or L; and X$_{82}$ is K or Q (SEQ ID NO:184), and (3) a VH CDR3 comprising X$_{83}$YYGNSFX$_{84}$X$_{85}$, wherein X$_{83}$ is F or I; X$_{84}$ is V, D, or A; and X$_{85}$ is Y, N, or H (SEQ ID NO:185); and/or (b) a VL comprising (1) a VL CDR1 comprising KSSQX$_{86}$LLNSGNQKNYLT, wherein X$_{86}$ is S or T (SEQ ID NO:195); (2) VL CDR2 comprising WASTRES (SEQ ID NO:143); and (3) a VL CDR3 comprising QNX$_{87}$YX$_{88}$X$_{89}$PX$_{90}$T, wherein X$_{87}$ is A, D, or N; X$_{88}$ is I, S, T, or Y; X$_{89}$ is Y or F; X$_{90}$ is L or V (SEQ ID NO:196).

In some embodiments, provided herein are binding moieties that specifically bind to Claudin18.2, comprising (a) a VH comprising (1) a VH CDR1 comprising SGFTFSSFGMH (SEQ ID NO:80); (2) a VH CDR2 comprising YISSGSSTIYYADTVKG (SEQ ID NO: 199); and (3) a VH CDR3 comprising FYYGNSFAY (SEQ ID NO:130) or a variant thereof comprising up to about 5 amino acid substitutions in the CDRs; and/or (b) a VL comprising (1) a VL CDR1 comprising KSSQSLLNSGNQKNYLT (SEQ ID NO:136); (2) a VL CDR2 comprising WASTRES (SEQ ID NO:143); and (3) a VL CDR3 comprising QNAYSYPLT (SEQ ID NO:167) or a variant thereof comprising up to about 5 amino acid substitutions in the CDRs.

In some embodiments, provided herein are binding moieties that specifically bind to Claudin18.2, comprising (a) a VH comprising a VH CDR1, VH CDR2, and VH CDR3, comprising (1) the amino acid sequences of SEQ ID NOs: 80, 106, and 128, respectively; (2) the amino acid sequences of SEQ ID NOs: 81, 107, and 129, respectively; (3) the amino acid sequences of SEQ ID NOs: 82, 108, and 130, respectively; (4) the amino acid sequences of SEQ ID NOs: 80, 109, and 130, respectively; (5) the amino acid sequences of SEQ ID NOs: 83, 110, and 130, respectively; (6) the amino acid sequences of SEQ ID NOs: 80, 109, and 131, respectively; (7) the amino acid sequences of SEQ ID NOs: 80, 111, and 132, respectively; (8) the amino acid sequences of SEQ ID NOs: 84, 112, and 132, respectively; (9) the amino acid sequences of SEQ ID NOs: 80,110 and 130, respectively; or (10) the amino acid sequences of SEQ ID NOs:81, 391 and 129, respectively, or a variant thereof comprising up to about 5 amino acid substitutions in the CDRs; and/or (b) a VL comprising a VL CDR1, VL CDR2, and VL CDR3, comprising (1) the amino acid sequences of SEQ ID NOs: 136, 143, and 165, respectively; (2) the amino acid sequences of SEQ ID NOs: 136, 143, and 166, respectively; (3) the amino acid sequences of SEQ ID NOs: 136, 143, and 167, respectively; (4) the amino acid sequences of SEQ ID NOs: 141, 143, and 168, respectively; (5) the amino acid sequences of SEQ ID NOs: 136, 143, and 169, respectively; (6) the amino acid sequences of SEQ ID NOs: 141, 143, and 170, respectively; (7) the amino acid sequences of SEQ ID NOs: 136, 143, and 160, respectively; (8) the amino acid sequences of SEQ ID NOs: 136, 143, and 171, respectively; (9) the amino acid sequences of SEQ ID NOs:136, 143 and 162, respectively; (10) the amino acid sequences of SEQ ID NOs: 141, 143 and 167, respectively; or (11) the amino acid sequences of SEQ ID NOs:141, 143 and 166, respectively, or a variant thereof comprising up to about 5 amino acid substitutions in the CDRs.

In some embodiments, provided herein are binding moieties that specifically bind to Claudin18.2, comprising (a) a VH comprising a VH CDR1, CDR2, and CDR3 comprising the amino acid sequences of SEQ ID NOs: 80, 106, and 128, respectively; and/or (b) a VL comprising a VL CDR1, CDR2, and CDR3 comprising the amino acid sequences of SEQ ID NOs: 136, 143, and 165, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 81, 107, and 129, respectively; and/or (b) a VL comprising a VL CDR1, CDR2, and CDR3 comprising the amino acid sequences of SEQ ID NOs: 136, 143, and 166, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 82, 108, and 130, respectively; and/or (b) a VL comprising a VL CDR1, CDR2, and CDR3 comprising the amino acid sequences of SEQ ID NOs: 136, 143, and 167, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 80, 109, and 130, respectively; and/or (b) a VL comprising a VL CDR1, CDR2, and CDR3 comprising the amino acid sequences of SEQ ID NOs: 141, 143, and 168, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 83, 110, and 130, respectively; and/or (b) a VL comprising a VL CDR1, CDR2, and CDR3 comprising the amino acid sequences of SEQ ID NOs: 136, 143, and 169, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 80, 109, and 131, respectively; and/or (b) a VL comprising a VL CDR1, CDR2, and CDR3 comprising the amino acid sequences of SEQ ID NOs: 141, 143, and 170, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 80, 111, and 132, respectively; and/or (b) a VL comprising a VL CDR1, CDR2, and CDR3 comprising the amino acid sequences of SEQ ID NOs: 136, 143, and 160, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 84, 112, and 132, respectively; and/or (b) a VL comprising a VL CDR1, CDR2, and CDR3 comprising the amino acid sequences of SEQ ID NOs: 136, 143, and 171, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 81, 391, and 129, respectively; and/or (b) a VL comprising a VL CDR1, CDR2, and CDR3 comprising the amino acid sequences of SEQ ID NOs: 136, 143, and 162, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 80, 109, and 131, respectively; and/or (b) a VL comprising a VL CDR1, CDR2, and CDR3 comprising the amino acid sequences of SEQ ID NOs: 141, 143, and 167, respectively.

In some embodiments, provided herein are binding moieties that specifically bind to Claudin18.2, comprising (a) a VH comprising a VH CDR1, CDR2, and CDR3 comprising the amino acid sequences of SEQ ID NOs: 81, 107, and 129, respectively; and/or (b) a VL comprising a VL CDR1, CDR2, and CDR3 comprising the amino acid sequences of SEQ ID NOs: 141, 143, and 166, respectively.

In some embodiments, provided herein are binding moieties that specifically bind to Claudin18.2, comprising (a) a VH comprising a VH CDR1, VH CDR2, and VH CDR3, comprising (1) the amino acid sequences of SEQ ID NOs: 85, 113, and 133, respectively; (2) the amino acid sequences of SEQ ID NOs: 86, 114, and 134, respectively; (3) the amino acid sequences of SEQ ID NOs: 87, 115, and 131, respectively; (4) the amino acid sequences of SEQ ID NOs: 88, 116, and 135, respectively; (5) the amino acid sequences of SEQ ID NOs: 203, 211, and 225, respectively; (6) the amino acid sequences of SEQ ID NOs: 204, 212, and 226, respectively; (7) the amino acid sequences of SEQ ID NOs: 205, 213, and 227, respectively; (8) the amino acid sequences of SEQ ID NOs: 206, 214, and 131, respectively; (9) the amino acid sequences of SEQ ID NOs: 207, 215, and 228, respectively; (10) the amino acid sequences of SEQ ID NOs: 208, 216, and 229, respectively; (11) the amino acid sequences of SEQ ID NOs: 69, 90, and 230, respectively; (12) the amino acid sequences of SEQ ID NOs: 69, 217, and 117, respectively; (13) the amino acid sequences of SEQ ID NOs: 209, 218, and 231, respectively; (14) the amino acid sequences of SEQ ID NOs: 72, 219, and 117, respectively; (15) the amino acid sequences of SEQ ID NOs: 75, 220, and 120, respectively; (16) the amino acid sequences of SEQ ID NOs: 69, 221, and 117, respectively; (17) the amino acid sequences of SEQ ID NOs: 72, 222, and 118, respectively; (18) the amino acid sequences of SEQ ID NOs: 69, 223, and 118, respectively; (19) the amino acid sequences of SEQ ID NOs: 210, 224, and 232, respectively; (20) the amino acid sequences of SEQ ID NOs: 72, 217, and 118, respectively; (21) the amino acid sequences of SEQ ID NOs: 69, 90, and 117, respectively; (22) the amino acid sequences of SEQ ID NOs: 392, 393, and 394, respectively; (23) the amino acid sequences of SEQ ID NOs: 392, 395, and 396, respectively; (24) the amino acid sequences of SEQ ID NOs: 397, 398, and 399, respectively; (25) the amino acid sequences of SEQ ID NOs: 75, 400, and 120, respectively; (26) the amino acid sequences of SEQ ID NOs: 70, 401, and 120, respectively; (27) the amino acid sequences of SEQ ID NOs: 402, 403, and 404, respectively; (28) the amino acid sequences of SEQ ID NOs: 69, 219, and 117, respectively; (29) the amino acid sequences of SEQ ID NOs: 71, 405, and 117, respectively; (30) the amino acid sequences of SEQ ID NOs: 406, 407, and 408, respectively; (31) the amino acid sequences of SEQ ID NOs: 409, 410, and 411, respectively; (32) the amino acid sequences of SEQ ID NOs: 69, 219, and 416, respectively; (33) the amino acid sequences of SEQ ID NOs: 76, 412, and 411, respectively; (34) the amino acid sequences of SEQ ID NOs: 413, 414, and 415, respectively; (35) the amino acid sequences of SEQ ID NOs: 69, 219, and 416, respectively; (36) the amino acid sequences of SEQ ID NOs: 417, 418, and 232, respectively; (37) the amino acid sequences of SEQ ID NOs: 69, 419, and 420, respectively; (38) the amino acid sequences of SEQ ID NOs: 205, 421, and 422, respectively; (39) the amino acid sequences of SEQ ID NOs: 205, 423, and 424, respectively; (40) the amino acid sequences of SEQ ID NOs: 81, 391, and 129, respectively; (41) the amino acid sequences of SEQ ID NOs: 88, 425, and 135, respectively; (42) the amino acid sequences of SEQ ID NOs: 81, 426, and 129, respectively; (43) the amino acid sequences of SEQ ID NOs: 80, 109, and 130, respectively; (44) the amino acid sequences of SEQ ID NOs: 81, 391, and 129, respectively; (45) the amino acid sequences of SEQ ID NOs: 430, 391, and 431, respectively; (46) the amino acid sequences of SEQ ID NOs: 80, 109, and 129, respectively; (47) the amino acid sequences of SEQ ID NOs: 81, 432, and 129, respectively; (48) the amino acid sequences of SEQ ID NOs: 433, 391, and 129, respectively; (49) the amino acid sequences of SEQ ID NOs: 434, 435, and 129, respectively; (50) the amino acid sequences of SEQ ID NOs: 436, 428, and 429, respectively; (51) the amino acid sequences of SEQ ID NOs: 80, 437, and 129, respectively; (52) the amino acid sequences of SEQ ID NOs: 81, 438, and 129, respectively; (53) the amino acid sequences of SEQ ID NOs: 80, 439, and 441, respectively; (54) the amino acid sequences of SEQ ID NOs: 433, 391, and 431, respectively; (55) the amino acid sequences of SEQ ID NOs: 80, 442, and 443, respectively; (56) the amino acid sequences of SEQ ID NOs: 80, 440, and 441, respectively; (57) the amino acid sequences of SEQ ID NOs: 444, 445 and 446, respectively; (58) the amino acid sequences of SEQ ID NOs: 447, 448, and 449, respectively; (59) the amino acid sequences of SEQ ID NOs: 450, 451, and 452, respectively; (60) the amino acid sequences of SEQ ID NOs: 81, 453, and 129, respectively; or (61) the amino acid sequences of SEQ ID NOs: 69, 89, and 454, respectively; or a variant thereof comprising up to about 5 amino acid substitutions in the CDRs; and/or (b) a VL comprising a VL CDR1, VL CDR2, and VL CDR3, comprising (1) the amino acid sequences of SEQ ID NOs: 136, 143, and 172, respectively; (2) the amino acid sequences of SEQ ID NOs: 136, 143, and 167, respectively; (3) the amino acid sequences of SEQ ID NOs: 136, 143, and 173, respectively; (4) the amino acid sequences of SEQ ID NOs: 223, 241, and 242, respectively; (5) the amino acid sequences of SEQ ID NOs: 136, 143, and 243, respectively; (6) the amino acid sequences of SEQ ID NOs: 234, 143, and 244, respectively; (7) the amino acid sequences of SEQ ID NOs: 235, 143, and 245, respectively; (8) the amino acid sequences of SEQ ID NOs: 136, 143, and 163, respectively; (9) the amino acid sequences of SEQ ID NOs: 236, 143, and 246, respectively; (10) the amino acid sequences of SEQ ID NOs: 237, 143, and 151, respectively; (11) the amino acid sequences of SEQ ID NOs: 137, 143, and 247, respectively; (12) the amino acid sequences of SEQ ID NOs: 136, 143, and 248, respectively; (13) the amino acid sequences of SEQ ID NOs: 238, 143, and 157, respectively; (14) the amino acid sequences of SEQ ID NOs: 137, 145, and 160, respectively; (15) the amino acid sequences of SEQ ID NOs: 136, 143, and 150, respectively; (16) the amino acid sequences of SEQ ID NOs: 136, 143, and 151, respectively; (17) the amino acid sequences of SEQ ID NOs: 239, 143, and 249, respectively; (18) the amino acid sequences of SEQ ID NOs: 240, 143, and 245, respectively; (19) the amino acid sequences of SEQ ID NOs: 136, 143, and 250, respectively; (20) the amino acid sequences of SEQ ID NOs: 137, 143, and 153, respectively; (21) the amino acid sequences of SEQ ID NOs: 136, 143, and 163, respectively; (22) the amino acid sequences of SEQ ID NOs: 456, 457, and 250, respectively; (23) the amino acid sequences of SEQ ID NOs: 458, 146, and 160, respectively; (24) the amino acid sequences of SEQ ID NOs: 136, 145, and 160, respectively; (25) the amino acid sequences of SEQ ID NOs: 240, 143, and 244, respectively; (26) the amino acid sequences of SEQ ID NOs: 137, 143, and 157, respectively; (27) the amino acid sequences of SEQ ID NOs: 136, 143, and 459, respectively; (28) the amino acid sequences of SEQ ID NOs: 460, 461, and 462, respectively; (29) the amino acid sequences of SEQ ID NOs: 137, 463, and 464, respectively; (30) the amino acid sequences of SEQ ID NOs: 465, 466, and 162, respectively; (31) the amino acid sequences of SEQ ID NOs: 140, 147, and 160, respectively; (32) the amino acid sequences of SEQ ID NOs: 136, 143, and 457, respectively; (32) the amino acid sequences of SEQ ID NOs: 136, 143, and 244, respectively; (33) the amino acid sequences of SEQ ID NOs: 136, 143, and 468, respectively; (34) the amino acid sequences of SEQ ID NOs: 136, 143, and 469, respectively; (35) the amino acid sequences of SEQ ID NOs: 136, 143, and 154, respectively; (36) the amino acid sequences of SEQ ID NOs: 240, 143, and 166, respectively; (37) the amino acid sequences of SEQ ID NOs: 136, 143, and 470, respectively; (38) the amino acid sequences of SEQ ID NOs: 136, 143, and 166, respectively; (39) the amino acid sequences of SEQ ID NOs: 136, 143, and 471, respectively; (40) the amino acid sequences of SEQ ID NOs: 472, 473, and 474, respectively; (41) the amino acid sequences of SEQ ID NOs: 475, 143, and 166, respectively; (42) the amino acid sequences of SEQ ID NOs: 476, 143, and 166, respectively; (43) the amino acid sequences of SEQ ID NOs: 136, 143, and 477, respectively; (44) the amino acid sequences of SEQ ID NOs: 478, 143, and 166, respectively; (45) the amino acid sequences of SEQ ID NOs: 479, 143, and 163, respectively; (46) the amino acid sequences of SEQ ID NOs: 480, 143, and 481, respectively; (47) the amino acid sequences of SEQ ID NOs: 482, 143, and 483, respectively; (48) the amino acid sequences of SEQ ID NOs: 136, 143, and 160, respectively; (49) the amino acid sequences of SEQ ID NOs: 482, 143, and 484, respectively; (50) the amino acid sequences of SEQ ID NOs: 485, 486, and 487, respectively; (51) the amino acid sequences of SEQ ID NOs: 488, 489, and 490, respectively; (52) the amino acid sequences of SEQ ID NOs: 491, 492, and 493, respectively; or (53) the amino acid sequences of SEQ ID NOs: 136, 143, and 494, respectively; or a variant thereof comprising up to about 5 amino acid substitutions in the CDRs.

In some embodiments, provided herein are binding moieties that specifically bind to Claudin18.2, comprising (a) VH comprising a VH CDR1, CDR2, and CDR3 comprise the amino acid sequences of SEQ ID NOs: 85, 113, and 133, respectively; and/or (b) a VL comprising a VL CDR1, CDR2, and CDR3 comprising the amino acid sequences of SEQ ID NOs: 136, 143, and 172, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 86, 114, and 134, respectively; and/or (b) a VL comprising VL CDR1, CDR2, and CDR3 comprising the amino acid sequences of SEQ ID NOs: 136, 143, and 172, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 87, 115, and 131, respectively; and/or (b) a VL comprising VL CDR1, CDR2, and CDR3 comprising the amino acid sequences of SEQ ID NOs: 136, 143, and 167, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 88, 116, and 135, respectively; and/or (b) a VL comprising VL CDR1, CDR2, and CDR3 comprising the amino acid sequences of SEQ ID NOs: 136, 143, and 173, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 203, 211, and 225, respectively; and/or (b) a VL comprising VL CDR1, CDR2, and CDR3 comprising the amino acid sequences of SEQ ID NOs: 223, 241, and 242, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 204, 212, and 226, respectively; and/or (b) a VL comprising VL CDR1, CDR2, and CDR3 comprising the amino acid sequences of SEQ ID NOs: 136, 143, and 243, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 205, 213, and 227, respectively; and/or (b) a VL comprising VL CDR1, CDR2, and CDR3 comprising the amino acid sequences of SEQ ID NOs: 234, 143, and 244, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 206, 214, and 131, respectively; and/or (b) a VL comprising VL CDR1, CDR2, and CDR3 comprising the amino acid sequences of SEQ ID NOs: 235, 143, and 245, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 207, 215, and 228, respectively; and/or (b) a VL comprising VL CDR1, CDR2, and CDR3 comprising the amino acid sequences of SEQ ID NOs: 136, 143, and 163, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 208, 216, and 229, respectively; and/or (b) a VL comprising VL CDR1, CDR2, and CDR3 comprising the amino acid sequences of SEQ ID NOs: 236, 143, and 246, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 90, and 230, respectively; and/or (b) a VL comprising VL CDR1, CDR2, and CDR3 comprising the amino acid sequences of SEQ ID NOs: 237, 143, and 151, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 217, and 117, respectively; and/or (b) a VL comprising VL CDR1, CDR2, and CDR3 comprising the amino acid sequences of SEQ ID NOs: 137, 143, and 247, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 209, 218, and 231, respectively; and/or (b) a VL comprising VL CDR1, CDR2, and CDR3 comprising the amino acid sequences of SEQ ID NOs: 136, 143, and 248, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 72, 219, and 117, respectively; and/or (b) a VL comprising VL CDR1, CDR2, and CDR3 comprising the amino acid sequences of SEQ ID NOs: 238, 143, and 157, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 75, 220, and 120, respectively; and/or (b) a VL comprising VL CDR1, CDR2, and CDR3 comprising the amino acid sequences of SEQ ID NOs: 137, 145, and 160, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 221, and 117, respectively; and/or (b) a VL comprising VL CDR1, CDR2, and CDR3 comprising the amino acid sequences of SEQ ID NOs: 136, 143, and 150, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 72, 222, and 118, respectively; and/or (b) a VL comprising VL CDR1, CDR2, and CDR3 comprising the amino acid sequences of SEQ ID NOs: 136, 143, and 151, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 223, and 118, respectively; and/or (b) a VL comprising VL CDR1, CDR2, and CDR3 comprising the amino acid sequences of SEQ ID NOs: 239, 143, and 249, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 210, 224, and 232, respectively; and/or (b) a VL comprising VL CDR1, CDR2, and CDR3 comprising the amino acid sequences of SEQ ID NOs: 240, 143, and 245, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 72, 217, and 118, respectively; and/or (b) a VL comprising VL CDR1, CDR2, and CDR3 comprising the amino acid sequences of SEQ ID NOs: 136, 143, and 250, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 90, and 117, respectively; and/or (b) a VL comprising VL CDR1, CDR2, and CDR3 comprising the amino acid sequences of SEQ ID NOs: 137, 143, and 153, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 85, 113, and 133, respectively; and/or (b) a VL comprising VL CDR1, CDR2, and CDR3 comprising the amino acid sequences of SEQ ID NOs: 136, 143, and 172, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 392, 393, and 394, respectively; and/or (b) a VL comprising VL CDR1, CDR2, and CDR3 comprising the amino acid sequences of SEQ ID NOs: 136, 143, and 163, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 392, 395, and 396, respectively; and/or (b) a VL comprising VL CDR1, CDR2, and CDR3 comprising the amino acid sequences of SEQ ID NOs: 136, 143, and 163, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 397, 398, and 399, respectively; and/or (b) a VL comprising VL CDR1, CDR2, and CDR3 comprising the amino acid sequences of SEQ ID NOs: 456, 457, and 250, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 75, 400, and 120, respectively; and/or (b) a VL comprising VL CDR1, CDR2, and CDR3 comprising the amino acid sequences of SEQ ID NOs: 458, 146, and 160, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 70, 401, and 120, respectively; and/or (b) a VL comprising VL CDR1, CDR2, and CDR3 comprising the amino acid sequences of SEQ ID NOs: 136, 145, and 160, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 402, 403, and 404, respectively; and/or (b) a VL comprising VL CDR1, CDR2, and CDR3 comprising the amino acid sequences of SEQ ID NOs: 240, 143, and 244, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 219, and 117, respectively; and/or (b) a VL comprising VL CDR1, CDR2, and CDR3 comprising the amino acid sequences of SEQ ID NOs: 137, 143, and 157, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 71, 405, and 117, respectively; and/or (b) a VL comprising VL CDR1, CDR2, and CDR3 comprising the amino acid sequences of SEQ ID NOs: 136, 143, and 459, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 406, 407, and 408, respectively; and/or (b) a VL comprising VL CDR1, CDR2, and CDR3 comprising the amino acid sequences of SEQ ID NOs: 460, 461, and 462, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 90, and 117, respectively; and/or (b) a VL comprising VL CDR1, CDR2, and CDR3 comprising the amino acid sequences of SEQ ID NOs: 137, 463, and 464, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 409, 410, and 411, respectively; and/or (b) a VL comprising VL CDR1, CDR2, and CDR3 comprising the amino acid sequences of SEQ ID NOs: 465, 466, and 162, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 219, and 416, respectively; and/or (b) a VL comprising VL CDR1, CDR2, and CDR3 comprising the amino acid sequences of SEQ ID NOs: 137, 143, and 157, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 76, 412, and 411, respectively; and/or (b) a VL comprising VL CDR1, CDR2, and CDR3 comprising the amino acid sequences of SEQ ID NOs: 140, 147, and 160, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 413, 414, and 415, respectively; and/or (b) a VL comprising VL CDR1, CDR2, and CDR3 comprising the amino acid sequences of SEQ ID NOs: 136, 143, and 467, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 417, 418, and 232, respectively; and/or (b) a VL comprising VL CDR1, CDR2, and CDR3 comprising the amino acid sequences of SEQ ID NOs: 136, 143, and 244, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 419, and 420, respectively; and/or (b) a VL comprising VL CDR1, CDR2, and CDR3 comprising the amino acid sequences of SEQ ID NOs: 136, 143, and 468, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 205, 421, and 422, respectively; and/or (b) a VL comprising VL CDR1, CDR2, and CDR3 comprising the amino acid sequences of SEQ ID NOs: 136, 143, and 469, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 205, 423, and 424, respectively; and/or (b) a VL comprising VL CDR1, CDR2, and CDR3 comprising the amino acid sequences of SEQ ID NOs: 136, 143, and 154, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 391, and 129, respectively; and/or (b) a VL comprising VL CDR1, CDR2, and CDR3 comprising the amino acid sequences of SEQ ID NOs: 240, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 88, 425, and 135, respectively; and/or (b) a VL comprising VL CDR1, CDR2, and CDR3 comprising the amino acid sequences of SEQ ID NOs: 136, 143, and 470, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 426, and 129, respectively; and/or (b) a VL comprising VL CDR1, CDR2, and CDR3 comprising the amino acid sequences of SEQ ID NOs: 136, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 109, and 130, respectively; and/or (b) a VL comprising VL CDR1, CDR2, and CDR3 comprising the amino acid sequences of SEQ ID NOs: 136, 143, and 471, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 427, 428, and 429, respectively; and/or (b) a VL comprising VL CDR1, CDR2, and CDR3 comprising the amino acid sequences of SEQ ID NOs: 472, 473, and 474, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 391, and 129, respectively; and/or (b) a VL comprising VL CDR1, CDR2, and CDR3 comprising the amino acid sequences of SEQ ID NOs: 475, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 430, 391, and 431, respectively; and/or (b) a VL comprising VL CDR1, CDR2, and CDR3 comprising the amino acid sequences of SEQ ID NOs: 476, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 109, and 129, respectively; and/or (b) a VL comprising VL CDR1, CDR2, and CDR3 comprising the amino acid sequences of SEQ ID NOs: 136, 143, and 477, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 391, and 129, respectively; and/or (b) a VL comprising VL CDR1, CDR2, and CDR3 comprising the amino acid sequences of SEQ ID NOs: 478, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 432, and 129, respectively; and/or (b) a VL comprising VL CDR1, CDR2, and CDR3 comprising the amino acid sequences of SEQ ID NOs: 475, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 433, 391, and 129, respectively; and/or (b) a VL comprising VL CDR1, CDR2, and CDR3 comprising the amino acid sequences of SEQ ID NOs: 475, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 109, and 129, respectively; and/or (b) a VL comprising VL CDR1, CDR2, and CDR3 comprising the amino acid sequences of SEQ ID NOs: 479, 143, and 163, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 434, 435, and 129, respectively; and/or (b) a VL comprising VL CDR1, CDR2, and CDR3 comprising the amino acid sequences of SEQ ID NOs: 240, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 436, 428, and 429, respectively; and/or (b) a VL comprising VL CDR1, CDR2, and CDR3 comprising the amino acid sequences of SEQ ID NOs: 472, 473, and 474, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 437, and 129, respectively; and/or (b) a VL comprising VL CDR1, CDR2, and CDR3 comprising the amino acid sequences of SEQ ID NOs: 479, 143, and 163, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 391, and 129, respectively; and/or (b) a VL comprising VL CDR1, CDR2, and CDR3 comprising the amino acid sequences of SEQ ID NOs: 478, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 438, and 129, respectively; and/or (b) a VL comprising VL CDR1, CDR2, and CDR3 comprising the amino acid sequences of SEQ ID NOs: 136, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 391, and 129, respectively; and/or (b) a VL comprising VL CDR1, CDR2, and CDR3 comprising the amino acid sequences of SEQ ID NOs: 480, 143, and 481, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 439, and 441, respectively; and/or (b) a VL comprising VL CDR1, CDR2, and CDR3 comprising the amino acid sequences of SEQ ID NOs: 482, 143, and 483, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 433, 391, and 431, respectively; and/or (b) a VL comprising VL CDR1, CDR2, and CDR3 comprising the amino acid sequences of SEQ ID NOs: 475, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 442, and 443, respectively; and/or (b) a VL comprising VL CDR1, CDR2, and CDR3 comprising the amino acid sequences of SEQ ID NOs: 136, 143, and 160, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 80, 440, and 441, respectively; and/or (b) a VL comprising VL CDR1, CDR2, and CDR3 comprising the amino acid sequences of SEQ ID NOs: 482, 143, and 484, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 444, 445, and 446, respectively; and/or (b) a VL comprising VL CDR1, CDR2, and CDR3 comprising the amino acid sequences of SEQ ID NOs: 485, 486, and 487, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 447, 448, and 449, respectively; and/or (b) a VL comprising VL CDR1, CDR2, and CDR3 comprising the amino acid sequences of SEQ ID NOs: 488, 489, and 490, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 450, 451, and 452, respectively; and/or (b) a VL comprising VL CDR1, CDR2, and CDR3 comprising the amino acid sequences of SEQ ID NOs: 491, 492, and 493, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 81, 453, and 129, respectively; and/or (b) a VL comprising VL CDR1, CDR2, and CDR3 comprising the amino acid sequences of SEQ ID NOs: 136, 143, and 166, respectively.

In some embodiments, provided herein are binding moieties that specifically bind to Claudin18.2, comprising (a) VH comprising VH CDR1, CDR2, and CDR3 comprise the amino acid sequences of SEQ ID NOs: 69, 89, and 454, respectively; and/or (b) a VL comprising VL CDR1, CDR2, and CDR3 comprising the amino acid sequences of SEQ ID NOs: 136, 143, and 494, respectively.

In some embodiments, provided herein are binding moieties that specifically bind to Claudin18.2, comprising: (i) a VH comprising an amino acid sequence having at least 80% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence having at least 80% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387.

In some embodiments, provided herein are binding moieties that specifically bind to Claudin18.2, comprising (i) a VH comprising an amino acid sequence having at least 85%, at least 90%, at least 95%, or at least 98% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and (ii) a VL comprising an amino acid sequence having at least 85%, at least 90%, at least 95%, or at least 98% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387.

In some embodiments, provided herein are binding moieties that specifically bind to Claudin18.2, comprising (i) a VH comprising an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and (ii) a VL comprising an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387.

In some embodiments, provided herein are binding moieties that specifically bind to Claudin18.2, wherein the VH and VL comprise: (1) the amino acid sequences of SEQ ID NOs: 1 and 2, respectively; (2) the amino acid sequences of SEQ ID NOs: 3 and 4, respectively; (3) the amino acid sequences of SEQ ID NOs: 5 and 6, respectively; (4) the amino acid sequences of SEQ ID NOs: 7 and 8, respectively; (5) the amino acid sequences of SEQ ID NOs: 9 and 10, respectively; (6) the amino acid sequences of SEQ ID NOs: 11 and 12, respectively; (7) the amino acid sequences of SEQ ID NOs: 13 and 14, respectively; (8) the amino acid sequences of SEQ ID NOs: 15 and 16, respectively; (9) the amino acid sequences of SEQ ID NOs: 17 and 18, respectively; (10) the amino acid sequences of SEQ ID NOs: 19 and 20, respectively; (11) the amino acid sequences of SEQ ID NOs: 21 and 22, respectively; (12) the amino acid sequences of SEQ ID NOs: 23 and 24, respectively; (13) the amino acid sequences of SEQ ID NOs: 25 and 26, respectively; (14) the amino acid sequences of SEQ ID NOs: 27 and 28, respectively; (15) the amino acid sequences of SEQ ID NOs: 29 and 30, respectively; (16) the amino acid sequences of SEQ ID NOs: 31 and 32, respectively; (17) the amino acid sequences of SEQ ID NOs: 33 and 34, respectively; (18) the amino acid sequences of SEQ ID NOs: 35 and 36, respectively; (19) the amino acid sequences of SEQ ID NOs: 37 and 38, respectively; (20) the amino acid sequences of SEQ ID NOs: 39 and 40, respectively; (21) the amino acid sequences of SEQ ID NOs: 41 and 42, respectively; (22) the amino acid sequences of SEQ ID NOs: 43 and 44, respectively; (23) the amino acid sequences of SEQ ID NOs: 45 and 46, respectively; (24) the amino acid sequences of SEQ ID NOs: 47 and 48, respectively; (25) the amino acid sequences of SEQ ID NOs: 49 and 50, respectively; (26) the amino acid sequences of SEQ ID NOs: 51 and 52, respectively; (27) the amino acid sequences of SEQ ID NOs: 53 and 54, respectively; (28) the amino acid sequences of SEQ ID NOs: 55 and 56, respectively; (29) the amino acid sequences of SEQ ID NOs: 57 and 58, respectively; (30) the amino acid sequences of SEQ ID NOs: 59 and 60, respectively; (31) the amino acid sequences of SEQ ID NOs: 61 and 62, respectively; (32) the amino acid sequences of SEQ ID NOs: 63 and 64, respectively; (33) the amino acid sequences of SEQ ID NOs: 65 and 66, respectively; (34) the amino acid sequences of SEQ ID NOs: 67 and 68, respectively; (35) the amino acid sequences of SEQ ID NOs: 251 and 252, respectively; (36) the amino acid sequences of SEQ ID NOs: 253 and 254, respectively; (37) the amino acid sequences of SEQ ID NOs: 255 and 256, respectively; (38) the amino acid sequences of SEQ ID NOs: 257 and 258, respectively; (39) the amino acid sequences of SEQ ID NOs: 259 and 260, respectively; (40) the amino acid sequences of SEQ ID NOs: 261 and 262, respectively; (41) the amino acid sequences of SEQ ID NOs: 263 and 264, respectively; (42) the amino acid sequences of SEQ ID NOs: 265 and 266, respectively; (43) the amino acid sequences of SEQ ID NOs: 267 and 268, respectively; (44) the amino acid sequences of SEQ ID NOs: 269 and 270, respectively; (45) the amino acid sequences of SEQ ID NOs: 271 and 272, respectively; (46) the amino acid sequences of SEQ ID NOs: 273 and 274, respectively; (47) the amino acid sequences of SEQ ID NOs: 275 and 276, respectively; (48) the amino acid sequences of SEQ ID NOs: 277 and 278, respectively; (49) the amino acid sequences of SEQ ID NOs: 279 and 280, respectively; (50) the amino acid sequences of SEQ ID NOs: 281 and 282, respectively; (51) the amino acid sequences of SEQ ID NOs: 283 and 284, respectively; (52) the amino acid sequences of SEQ ID NOs: 285 and 286, respectively; (53) the amino acid sequences of SEQ ID NOs: 287 and 288, respectively; (54) the amino acid sequences of SEQ ID NOs: 289 and 290, respectively; (55) the amino acid sequence of any one of SEQ ID NOs: 337-345 and the amino acid sequence of SEQ ID NO.: 346, respectively; (56) the amino acid sequence of any one of SEQ ID NOs: 337-345 and the amino acid sequence of SEQ ID NO.: 347, respectively; (57) the amino acid sequence of any one of SEQ ID NOs: 348-352 and the amino acid sequence of SEQ ID Nos: 353, respectively; (58) the amino acid sequence of any one of SEQ ID NOs: 348-352 and the amino acid sequence of SEQ ID Nos: 354, respectively; (59) the amino acid sequence of any one of SEQ ID NOs: 355-362 and the amino acid sequence of SEQ ID NO: 363, respectively; (60) the amino acid sequence of any one of SEQ ID NOs: 355-362 and the amino acid sequence of SEQ ID NO: 364, respectively; (61) the amino acid sequence of any one of SEQ ID NOs: 365-369 and the amino acid sequence of SEQ ID NO: 370, respectively; (62) the amino acid sequence of any one of SEQ ID NOs: 365-369 and the amino acid sequence of SEQ ID NO: 371, respectively; (63) the amino acid sequence of any one of SEQ ID NOs: 372-374 and the amino acid sequence of any one of SEQ ID Nos: 375-377, respectively; (64) the amino acid sequence of any one of SEQ ID NOs: 378-380 and the amino acid sequence of SEQ ID NO: 381, respectively; (65) the amino acid sequence of any one of SEQ ID NOs: 378-380 and the amino acid sequence of SEQ ID NO: 382, respectively; (66) the amino acid sequence of any one of SEQ ID NOs: 383-385 and the amino acid sequence of SEQ ID NO: 386, respectively; (67) the amino acid sequence of any one of SEQ ID NOs: 383-385 and the amino acid sequence of SEQ ID NO: 387, respectively; (68) the amino acid sequences of SEQ ID NOs: 495 and 496, respectively; (69) the amino acid sequences of SEQ ID NOs: 497 and 498, respectively; (70) the amino acid sequences of SEQ ID NOs: 499 and 500, respectively; (71) the amino acid sequences of SEQ ID NOs: 501 and 502, respectively; (72) the amino acid sequences of SEQ ID NOs: 503 and 504, respectively; (73) the amino acid sequences of SEQ ID NOs: 505 and 506, respectively; (74) the amino acid sequences of SEQ ID NOs: 507 and 508, respectively; (75) the amino acid sequences of SEQ ID NOs: 509 and 510, respectively; (76) the amino acid sequences of SEQ ID NOs: 511 and 512, respectively; (77) the amino acid sequences of SEQ ID NOs: 513 and 514, respectively; (78) the amino acid sequences of SEQ ID NOs: 515 and 516, respectively; (79) the amino acid sequences of SEQ ID NOs: 517 and 518, respectively; (80) the amino acid sequences of SEQ ID NOs: 519 and 520, respectively; (81) the amino acid sequences of SEQ ID NOs: 521 and 522, respectively; (82) the amino acid sequences of SEQ ID NOs: 523 and 524, respectively; (83) the amino acid sequences of SEQ ID NOs: 525 and 526, respectively; (84) the amino acid sequences of SEQ ID NOs: 527 and 528, respectively; (85) the amino acid sequences of SEQ ID NOs: 529 and 530, respectively; (86) the amino acid sequences of SEQ ID NOs: 531 and 532, respectively; (87) the amino acid sequences of SEQ ID NOs: 533 and 534, respectively; (88) the amino acid sequences of SEQ ID NOs: 535 and 536, respectively; (89) the amino acid sequences of SEQ ID NOs: 537 and 538, respectively; (90) the amino acid sequences of SEQ ID NOs: 539 and 540, respectively; (91) the amino acid sequences of SEQ ID NOs: 541 and 542, respectively; (92) the amino acid sequences of SEQ ID NOs: 543 and 544, respectively; (93) the amino acid sequences of SEQ ID NOs: 545 and 546, respectively; (94) the amino acid sequences of SEQ ID NOs: 547 and 548, respectively; (95) the amino acid sequences of SEQ ID NOs: 549 and 550, respectively; (96) the amino acid sequences of SEQ ID NOs: 551 and 552, respectively; (97) the amino acid sequences of SEQ ID NOs: 553 and 554, respectively; (98) the amino acid sequences of SEQ ID NOs: 555 and 556, respectively; (99) the amino acid sequences of SEQ ID NOs: 557 and 558, respectively; (100) the amino acid sequences of SEQ ID NOs: 559 and 560, respectively; (101) the amino acid sequences of SEQ ID NOs: 561 and 562, respectively; (102) the amino acid sequences of SEQ ID NOs: 563 and 564, respectively; (103) the amino acid sequences of SEQ ID NOs: 565 and 566, respectively; (104) the amino acid sequences of SEQ ID NOs: 567 and 568, respectively; (105) the amino acid sequences of SEQ ID NOs: 569 and 570, respectively; (106) the amino acid sequences of SEQ ID NOs: 571 and 572, respectively; (107) the amino acid sequences of SEQ ID NOs: 573 and 574, respectively; (108) the amino acid sequences of SEQ ID NOs: 575 and 576, respectively; (109) the amino acid sequences of SEQ ID NOs: 577 and 578, respectively; (110) the amino acid sequences of SEQ ID NOs: 579 and 580, respectively; (111) the amino acid sequences of SEQ ID NOs: 581 and 582, respectively; (112) the amino acid sequences of SEQ ID NOs: 583 and 584, respectively; (113) the amino acid sequences of SEQ ID NOs: 585 and 586, respectively; (114) the amino acid sequences of SEQ ID NOs: 587 and 588, respectively; (115) the amino acid sequences of SEQ ID NOs: 589 and 590, respectively; (116) the amino acid sequences of SEQ ID NOs: 591 and 592, respectively; (117) the amino acid sequences of SEQ ID NOs: 1593 and 594, respectively; (118) the amino acid sequences of SEQ ID NOs: 595 and 596, respectively; (119) the amino acid sequences of SEQ ID NOs: 597 and 598, respectively; (120) the amino acid sequences of SEQ ID NOs: 599 and 600, respectively; (121) the amino acid sequences of SEQ ID NOs: 601 and 602, respectively; (122) the amino acid sequences of SEQ ID NOs: 603 and 604, respectively; (123) the amino acid sequences of SEQ ID NOs: 605 and 606, respectively; (124) the amino acid sequences of SEQ ID NOs: 607 and 608, respectively; (125) the amino acid sequences of SEQ ID NOs: 609 and 610, respectively; (126) the amino acid sequences of SEQ ID NOs: 611 and 612, respectively; (127) the amino acid sequences of SEQ ID NOs: 613 and 614, respectively; (128) the amino acid sequences of SEQ ID NOs: 615 and 616, respectively; (129) the amino acid sequences of SEQ ID NOs: 617 and 618, respectively; (130) the amino acid sequences of SEQ ID NOs: 619 and 620, respectively; (131) the amino acid sequences of SEQ ID NOs: 621 and 622, respectively; (132) the amino acid sequences of SEQ ID NOs: 623 and 624, respectively; (133) the amino acid sequences of SEQ ID NOs: 625 and 626, respectively; (134) the amino acid sequences of SEQ ID NOs: 627 and 628, respectively; (135) the amino acid sequences of SEQ ID NOs: 629 and 630, respectively; (136) the amino acid sequences of SEQ ID NOs: 631 and 632, respectively; (137) the amino acid sequences of SEQ ID NOs: 633 and 634, respectively; (138) the amino acid sequences of SEQ ID NOs: 635 and 636, respectively; (139) the amino acid sequences of SEQ ID NOs: 637 and 638, respectively; (140) the amino acid sequences of SEQ ID NOs: 639 and 640, respectively; (141) the amino acid sequences of SEQ ID NOs: 641 and 642, respectively; (142) the amino acid sequences of SEQ ID NOs: 643 and 644, respectively; (143) the amino acid sequences of SEQ ID NOs: 645 and 646, respectively; (144) the amino acid sequences of SEQ ID NOs: 647 and 648, respectively; (145) the amino acid sequences of SEQ ID NOs: 649 and 650, respectively; (155) the amino acid sequences of SEQ ID NOs: 651 and 652, respectively; (156) the amino acid sequences of SEQ ID NOs: 653 and 654, respectively; (157) the amino acid sequences of SEQ ID NOs: 655 and 656, respectively; (158) the amino acid sequences of SEQ ID NOs: 657 and 658, respectively; (159) the amino acid sequences of SEQ ID NOs: 659 and 660, respectively; (160) the amino acid sequences of SEQ ID NOs: 661 and 662, respectively; (167) the amino acid sequences of SEQ ID NOs: 663 and 664, respectively; (168) the amino acid sequences of SEQ ID NOs: 665 and 666, respectively; (169) the amino acid sequences of SEQ ID NOs: 667 and 668, respectively; (170) the amino acid sequences of SEQ ID NOs: 669 and 670, respectively; (171) the amino acid sequences of SEQ ID NOs: 671 and 672, respectively; (172) the amino acid sequences of SEQ ID NOs: 673 and 674, respectively; (173) the amino acid sequences of SEQ ID NOs: 675 and 676, respectively; (174) the amino acid sequences of SEQ ID NOs:677 and 678, respectively; (175) the amino acid sequences of SEQ ID NOs: 679 and 680, respectively; or a variant thereof comprising up to about 5 amino acid substitutions in the VH and/or VL.

In some embodiments, provided herein are binding moieties that specifically bind to Claudin18.2, comprising a VH comprising a VH CDR1, CDR2, and CDR3 and a VL comprising a VL CDR1, CDR2, and CDR3 from an antibody comprising a VH and a VL having: (1) the amino acid sequences of SEQ ID NOs: 1 and 2, respectively; (2) the amino acid sequences of SEQ ID NOs: 3 and 4, respectively; (3) the amino acid sequences of SEQ ID NOs: 5 and 6, respectively; (4) the amino acid sequences of SEQ ID NOs: 7 and 8, respectively; (5) the amino acid sequences of SEQ ID NOs: 9 and 10, respectively; (6) the amino acid sequences of SEQ ID NOs: 11 and 12, respectively; (7) the amino acid sequences of SEQ ID NOs: 13 and 14, respectively; (8) the amino acid sequences of SEQ ID NOs: 15 and 16, respectively; (9) the amino acid sequences of SEQ ID NOs: 17 and 18, respectively; (10) the amino acid sequences of SEQ ID NOs: 19 and 20, respectively; (11) the amino acid sequences of SEQ ID NOs: 21 and 22, respectively; (12) the amino acid sequences of SEQ ID NOs: 23 and 24, respectively; (13) the amino acid sequences of SEQ ID NOs: 25 and 26, respectively; (14) the amino acid sequences of SEQ ID NOs: 27 and 28, respectively; (15) the amino acid sequences of SEQ ID NOs: 29 and 30, respectively; (16) the amino acid sequences of SEQ ID NOs: 31 and 32, respectively; (17) the amino acid sequences of SEQ ID NOs: 33 and 34, respectively; (18) the amino acid sequences of SEQ ID NOs: 35 and 36, respectively; (19) the amino acid sequences of SEQ ID NOs: 37 and 38, respectively; (20) the amino acid sequences of SEQ ID NOs: 39 and 40, respectively; (21) the amino acid sequences of SEQ ID NOs: 41 and 42, respectively; (22) the amino acid sequences of SEQ ID NOs: 43 and 44, respectively; (23) the amino acid sequences of SEQ ID NOs: 45 and 46, respectively; (24) the amino acid sequences of SEQ ID NOs: 47 and 48, respectively; (25) the amino acid sequences of SEQ ID NOs: 49 and 50, respectively; (26) the amino acid sequences of SEQ ID NOs: 51 and 52, respectively; (27) the amino acid sequences of SEQ ID NOs: 53 and 54, respectively; (28) the amino acid sequences of SEQ ID NOs: 55 and 56, respectively; (29) the amino acid sequences of SEQ ID NOs: 57 and 58, respectively; (30) the amino acid sequences of SEQ ID NOs: 59 and 60, respectively; (31) the amino acid sequences of SEQ ID NOs: 61 and 62, respectively; (32) the amino acid sequences of SEQ ID NOs: 63 and 64, respectively; (33) the amino acid sequences of SEQ ID NOs: 65 and 66, respectively; (34) the amino acid sequences of SEQ ID NOs: 67 and 68, respectively; (35) the amino acid sequences of SEQ ID NOs: 251 and 252, respectively; (36) the amino acid sequences of SEQ ID NOs: 253 and 254, respectively; (37) the amino acid sequences of SEQ ID NOs: 255 and 256, respectively; (38) the amino acid sequences of SEQ ID NOs: 257 and 258, respectively; (39) the amino acid sequences of SEQ ID NOs: 259 and 260, respectively; (40) the amino acid sequences of SEQ ID NOs: 261 and 262, respectively; (41) the amino acid sequences of SEQ ID NOs: 263 and 264, respectively; (42) the amino acid sequences of SEQ ID NOs: 265 and 266, respectively; (43) the amino acid sequences of SEQ ID NOs: 267 and 268, respectively; (44) the amino acid sequences of SEQ ID NOs: 269 and 270, respectively; (45) the amino acid sequences of SEQ ID NOs: 271 and 272, respectively; (46) the amino acid sequences of SEQ ID NOs: 273 and 274, respectively; (47) the amino acid sequences of SEQ ID NOs: 275 and 276, respectively; (48) the amino acid sequences of SEQ ID NOs: 277 and 278, respectively; (49) the amino acid sequences of SEQ ID NOs: 279 and 280, respectively; (50) the amino acid sequences of SEQ ID NOs: 281 and 282, respectively; (51) the amino acid sequences of SEQ ID NOs: 283 and 284, respectively; (52) the amino acid sequences of SEQ ID NOs: 285 and 286, respectively; (53) the amino acid sequences of SEQ ID NOs: 287 and 288, respectively; (54) the amino acid sequences of SEQ ID NOs: 289 and 290, respectively; (55) the amino acid sequence of any one of SEQ ID NOs: 337-345 and the amino acid sequence of SEQ ID NO.: 346, respectively; (56) the amino acid sequence of any one of SEQ ID NOs: 337-345 and the amino acid sequence of SEQ ID NO.: 347, respectively; (57) the amino acid sequence of any one of SEQ ID NOs: 348-352 and the amino acid sequence of SEQ ID Nos: 353, respectively; (58) the amino acid sequence of any one of SEQ ID NOs: 348-352 and the amino acid sequence of SEQ ID Nos: 354, respectively; (59) the amino acid sequence of any one of SEQ ID NOs: 355-362 and the amino acid sequence of SEQ ID NO: 363, respectively; (60) the amino acid sequence of any one of SEQ ID NOs: 355-362 and the amino acid sequence of SEQ ID NO: 364, respectively; (61) the amino acid sequence of any one of SEQ ID NOs: 365-369 and the amino acid sequence of SEQ ID NO: 370, respectively; (62) the amino acid sequence of any one of SEQ ID NOs: 365-369 and the amino acid sequence of SEQ ID NO: 371, respectively; (63) the amino acid sequence of any one of SEQ ID NOs: 372-374 and the amino acid sequence of any one of SEQ ID Nos: 375-377, respectively; (64) the amino acid sequence of any one of SEQ ID NOs: 378-380 and the amino acid sequence of SEQ ID NO: 381, respectively; (65) the amino acid sequence of any one of SEQ ID NOs: 378-380 and the amino acid sequence of SEQ ID NO: 382, respectively; (66) the amino acid sequence of any one of SEQ ID NOs: 383-385 and the amino acid sequence of SEQ ID NO: 386, respectively; (67) the amino acid sequence of any one of SEQ ID NOs: 383-385 and the amino acid sequence of SEQ ID NO: 387, respectively; (68) the amino acid sequences of SEQ ID NOs: 495 and 496, respectively; (69) the amino acid sequences of SEQ ID NOs: 497 and 498, respectively; (70) the amino acid sequences of SEQ ID NOs: 499 and 500, respectively; (71) the amino acid sequences of SEQ ID NOs: 501 and 502, respectively; (72) the amino acid sequences of SEQ ID NOs: 503 and 504, respectively; (73) the amino acid sequences of SEQ ID NOs: 505 and 506, respectively; (74) the amino acid sequences of SEQ ID NOs: 507 and 508, respectively; (75) the amino acid sequences of SEQ ID NOs: 509 and 510, respectively; (76) the amino acid sequences of SEQ ID NOs: 511 and 512, respectively; (77) the amino acid sequences of SEQ ID NOs: 513 and 514, respectively; (78) the amino acid sequences of SEQ ID NOs: 515 and 516, respectively; (79) the amino acid sequences of SEQ ID NOs: 517 and 518, respectively; (80) the amino acid sequences of SEQ ID NOs: 519 and 520, respectively; (81) the amino acid sequences of SEQ ID NOs: 521 and 522, respectively; (82) the amino acid sequences of SEQ ID NOs: 523 and 524, respectively; (83) the amino acid sequences of SEQ ID NOs: 525 and 526, respectively; (84) the amino acid sequences of SEQ ID NOs: 527 and 528, respectively; (85) the amino acid sequences of SEQ ID NOs: 529 and 530, respectively; (86) the amino acid sequences of SEQ ID NOs: 531 and 532, respectively; (87) the amino acid sequences of SEQ ID NOs: 533 and 534, respectively; (88) the amino acid sequences of SEQ ID NOs: 535 and 536, respectively; (89) the amino acid sequences of SEQ ID NOs: 537 and 538, respectively; (90) the amino acid sequences of SEQ ID NOs: 539 and 540, respectively; (91) the amino acid sequences of SEQ ID NOs: 541 and 542, respectively; (92) the amino acid sequences of SEQ ID NOs: 543 and 544, respectively; (93) the amino acid sequences of SEQ ID NOs: 545 and 546, respectively; (94) the amino acid sequences of SEQ ID NOs: 547 and 548, respectively; (95) the amino acid sequences of SEQ ID NOs: 549 and 550, respectively; (96) the amino acid sequences of SEQ ID NOs: 551 and 552, respectively; (97) the amino acid sequences of SEQ ID NOs: 553 and 554, respectively; (98) the amino acid sequences of SEQ ID NOs: 555 and 556, respectively; (99) the amino acid sequences of SEQ ID NOs: 557 and 558, respectively; (100) the amino acid sequences of SEQ ID NOs: 559 and 560, respectively; (101) the amino acid sequences of SEQ ID NOs: 561 and 562, respectively; (102) the amino acid sequences of SEQ ID NOs: 563 and 564, respectively; (103) the amino acid sequences of SEQ ID NOs: 565 and 566, respectively; (104) the amino acid sequences of SEQ ID NOs: 567 and 568, respectively; (105) the amino acid sequences of SEQ ID NOs: 569 and 570, respectively; (106) the amino acid sequences of SEQ ID NOs: 571 and 572, respectively; (107) the amino acid sequences of SEQ ID NOs: 573 and 574, respectively; (108) the amino acid sequences of SEQ ID NOs: 575 and 576, respectively; (109) the amino acid sequences of SEQ ID NOs: 577 and 578, respectively; (110) the amino acid sequences of SEQ ID NOs: 579 and 580, respectively; (111) the amino acid sequences of SEQ ID NOs: 581 and 582, respectively; (112) the amino acid sequences of SEQ ID NOs: 583 and 584, respectively; (113) the amino acid sequences of SEQ ID NOs: 585 and 586, respectively; (114) the amino acid sequences of SEQ ID NOs: 587 and 588, respectively; (115) the amino acid sequences of SEQ ID NOs: 589 and 590, respectively; (116) the amino acid sequences of SEQ ID NOs: 591 and 592, respectively; (117) the amino acid sequences of SEQ ID NOs: 1593 and 594, respectively; (118) the amino acid sequences of SEQ ID NOs: 595 and 596, respectively; (119) the amino acid sequences of SEQ ID NOs: 597 and 598, respectively; (120) the amino acid sequences of SEQ ID NOs: 599 and 600, respectively; (121) the amino acid sequences of SEQ ID NOs: 601 and 602, respectively; (122) the amino acid sequences of SEQ ID NOs: 603 and 604, respectively; (123) the amino acid sequences of SEQ ID NOs: 605 and 606, respectively; (124) the amino acid sequences of SEQ ID NOs: 607 and 608, respectively; (125) the amino acid sequences of SEQ ID NOs: 609 and 610, respectively; (126) the amino acid sequences of SEQ ID NOs: 611 and 612, respectively; (127) the amino acid sequences of SEQ ID NOs: 613 and 614, respectively; (128) the amino acid sequences of SEQ ID NOs: 615 and 616, respectively; (129) the amino acid sequences of SEQ ID NOs: 617 and 618, respectively; (130) the amino acid sequences of SEQ ID NOs: 619 and 620, respectively; (131) the amino acid sequences of SEQ ID NOs: 621 and 622, respectively; (132) the amino acid sequences of SEQ ID NOs: 623 and 624, respectively; (133) the amino acid sequences of SEQ ID NOs: 625 and 626, respectively; (134) the amino acid sequences of SEQ ID NOs: 627 and 628, respectively; (135) the amino acid sequences of SEQ ID NOs: 629 and 630, respectively; (136) the amino acid sequences of SEQ ID NOs: 631 and 632, respectively; (137) the amino acid sequences of SEQ ID NOs: 633 and 634, respectively; (138) the amino acid sequences of SEQ ID NOs: 635 and 636, respectively; (139) the amino acid sequences of SEQ ID NOs: 637 and 638, respectively; (140) the amino acid sequences of SEQ ID NOs: 639 and 640, respectively; (141) the amino acid sequences of SEQ ID NOs: 641 and 642, respectively; (142) the amino acid sequences of SEQ ID NOs: 643 and 644, respectively; (143) the amino acid sequences of SEQ ID NOs: 645 and 646, respectively; (144) the amino acid sequences of SEQ ID NOs: 647 and 648, respectively; (145) the amino acid sequences of SEQ ID NOs: 649 and 650, respectively; (155) the amino acid sequences of SEQ ID NOs: 651 and 652, respectively; (156) the amino acid sequences of SEQ ID NOs: 653 and 654, respectively; (157) the amino acid sequences of SEQ ID NOs: 655 and 656, respectively; (158) the amino acid sequences of SEQ ID NOs: 657 and 658, respectively; (159) the amino acid sequences of SEQ ID NOs: 659 and 660, respectively; (160) the amino acid sequences of SEQ ID NOs: 661 and 662, respectively; (167) the amino acid sequences of SEQ ID NOs: 663 and 664, respectively; (168) the amino acid sequences of SEQ ID NOs: 665 and 666, respectively; (169) the amino acid sequences of SEQ ID NOs: 667 and 668, respectively; (170) the amino acid sequences of SEQ ID NOs: 669 and 670, respectively; (171)

the amino acid sequences of SEQ ID NOs: 671 and 672, respectively; (172) the amino acid sequences of SEQ ID NOs: 673 and 674, respectively; (173) the amino acid sequences of SEQ ID NOs: 675 and 676, respectively; (174) the amino acid sequences of SEQ ID NOs:677 and 678, respectively; (175) the amino acid sequences of SEQ ID NOs: 679 and 680, respectively.

Provided herein are also binding moieties that compete with the binding moieties described herein for binding to Claudin18.2.

In some embodiments, the binding moieties disclosed herein do not bind Claudin18.1 at a detectable level. In some embodiments, the binding moieties disclosed herein bind Claudin18.2 with an affinity that is at least 50 fold greater than its affinity to Claudin18.1.

In some embodiments, the binding moiety disclosed herein comprises or is an antibody. In some embodiments, the binding moiety disclosed herein comprises or is a monoclonal antibody. In some embodiments, the binding moiety disclosed herein comprises or is a bispecific or a multispecific antibody. In some embodiments, the binding moiety provided herein is selected from the group consisting of a Fab, a Fab', a F(ab')$_2$, a Fv, a scFv, and a (scFv)$_2$. In some embodiments, the binding moiety provided herein is a scFv. In some embodiments, the binding moiety provided herein is an IgG1 antibody, an IgG2 antibody, an IgG3 antibody, or an IgG4 antibody. In some embodiments, the binding moiety provided herein is a chimeric antibody, a humanized antibody, or a human antibody, or an antigen-binding fragment thereof. In some embodiments, the binding moiety provided herein is a humanized antibody.

The antibodies described herein may contain a heavy chain constant region, linked to the C-terminus of the heavy chain variable region, and/or a light chain constant region, linked to the C-terminus of the light chain variable region. The heavy chain constant region may be a human IgG1 heavy chain constant region having an amino acid sequence set forth in e.g., SEQ ID NO: 388. The light chain constant region may be a human kappa light chain constant region having an amino acid sequence set forth in e.g., SEQ ID NO: 389.

In some embodiments, provided herein are polynucleotides encoding the binding moieties described herein. In some embodiments, provided herein are vectors comprising the polynucleotides described herein.

In some embodiments, provided herein are isolated cells comprising the polynucleotides described herein. In some embodiments, provided herein are isolated cells comprising the vectors described herein.

In another aspect, the present application provides a chimeric antigen receptor (CAR) comprising an anti-Claudin18.2 single chain variable fragment (scFv), the anti-Claudin18.2 scFv comprising CDRs or heavy/light chain variable regions as described herein for the Claudin18.2 binding moieties.

In some embodiments, the anti-Claudin18.2 CAR comprises (a) an extracellular antigen binding domain comprising an anti-Claudin18.2 single chain variable fragment (scFv), the anti-Claudin18.2 scFv comprising CDRs or heavy/light chain variable regions as described above for the Claudin18.2 binding moieties; (b) a transmembrane domain; and (c) an intracellular signaling domain.

In some embodiments, the CAR comprises a heavy chain variable region having VH CDR1, CDR2, and CDR3 and a light chain variable region having VL CDR1, CDR2, and CDR3, the VH CDR1, CDR2, CDR3 and the VL CDR1, CDR2, CDR3 comprise amino acid sequences set forth in (1) SEQ ID NOs: 69, 89, 117, 136, 143 and 150, respectively; (2) SEQ ID NOs: 69, 90, 117, 137, 143 and 151, respectively; (3) SEQ ID NOs: 69, 90, 117, 137, 143 and 151, respectively; (4) SEQ ID NOs: 70, 90, 117, 136, 143 and 152, respectively; (5) SEQ ID NOs: 69, 91, 117, 137, 143 and 153, respectively; (6) SEQ ID NOs: 71, 92, 117, 136, 143 and 154, respectively; (7) SEQ ID NOs: 71, 92, 117, 136, 143 and 154, respectively; (8) SEQ ID NOs: 72, 93, 117, 136, 143 and 155, respectively; (9) SEQ ID NOs: 69, 94, 118, 136, 143 and 156, respectively; (10) SEQ ID NOs: 73, 95, 117, 137, 143 and 157, respectively; (11) SEQ ID NOs: 74, 96, 119, 136, 144 and 158, respectively; (12) SEQ ID NOs: 74, 96, 119, 136, 144 and 158, respectively; (13) SEQ ID NOs: 70, 97, 120, 138, 145 and 159, respectively; (14) SEQ ID NOs: 70, 98, 120, 136, 145 and 160, respectively; (15) SEQ ID NOs: 75, 99, 120, 139, 146 and 160, respectively; (16) SEQ ID NOs: 75, 100, 120, 139, 146 and 160, respectively; (17) SEQ ID NOs: 70, 90, 121, 137, 145 and 160, respectively; (18) SEQ ID NOs: 76, 101, 122, 140, 147 and 160, respectively; (19) SEQ ID NOs: 76, 101, 123, 136, 147 and 160, respectively; (20) SEQ ID NOs: 70, 201, 120, 137, 145 and 160, respectively; (21) SEQ ID NOs: 70, 202, 120, 136, 145 and 160, respectively; (22) SEQ ID NOs: 77, 102, 124, 141, 148 and 161, respectively; (23) SEQ ID NOs: 78, 103, 125, 136, 143 and 162, respectively; (24) SEQ ID NOs: 79, 104, 126, 136, 149 and 163, respectively; (25) SEQ ID NOs: 78, 105, 127, 142, 143 and 164, respectively; (26) SEQ ID NOs: 80, 106, 128, 136, 143 and 165, respectively; (27) SEQ ID NOs: 81, 107, 129, 136, 143 and 166, respectively; (28) SEQ ID NOs: 82, 108, 130, 136, 143 and 167, respectively; (29) SEQ ID NOs: 80, 109, 130, 141, 143 and 168, respectively; (30) SEQ ID NOs: 83, 110, 130, 136, 143 and 169, respectively; (31) SEQ ID NOs: 80, 109, 131, 141, 143 and 170, respectively; (32) SEQ ID NOs: 80, 111, 132, 136, 143 and 160, respectively; (33) SEQ ID NOs: 84, 112, 132, 136, 143 and 171, respectively; (34) SEQ ID NOs: 85, 113, 133, 136, 143 and 172, respectively; (35) SEQ ID NOs: 86, 114, 134, 136, 143 and 172, respectively; (36) SEQ ID NOs: 87, 115, 131, 136, 143 and 167, respectively; (37) SEQ ID NOs: 88, 116, 135, 136, 143 and 173, respectively; (38) SEQ ID NOs: 203, 211, 225, 233, 241 and 242, respectively; (39) SEQ ID NOs: 204, 212, 226, 136, 143 and 243, respectively; (40) SEQ ID NOs: 205, 213, 227, 234, 143 and 244, respectively; (41) SEQ ID NOs: 206, 214, 131, 235, 143 and 245, respectively; (42) SEQ ID NOs: 207, 215, 228, 136, 143 and 163, respectively; (43) SEQ ID NOs: 208, 216, 229, 236, 143 and 246, respectively; (44) SEQ ID NOs: 69, 90, 230, 237, 143 and 151, respectively; (45) SEQ ID NOs: 69, 217, 117, 137, 143 and 247, respectively; (46) SEQ ID NOs: 209, 218, 231, 136, 143 and 248, respectively; (47) SEQ ID NOs: 72, 219, 117, 238, 143 and 157, respectively; (48) SEQ ID NOs: 75, 220, 120, 137, 145 and 160, respectively; (49) SEQ ID NOs: 69, 221, 117, 136, 143 and 150 respectively; (50) SEQ ID NOs: 72, 222, 118, 136, 143 and 151, respectively; (51) SEQ ID NOs: 69, 223, 118, 239, 143 and 249, respectively; (52) SEQ ID NOs: 210, 224, 232, 240, 143 and 245, respectively; (53) SEQ ID NOs: 72, 217, 118, 136, 143 and 250, respectively; (54) SEQ ID NOs: 69, 90, 117, 137, 143 and 153, respectively; (55) SEQ ID NOs:74, 96, 130, 136, 144 and 158, respectively; (56) SEQ ID NOs: 69, 202, 118, 136, 143, and 455, respectively; (57) SEQ ID NOs: 72, 90, 117, 137, 143, and 153, respectively; (58) SEQ ID NOs: 69, 390, 118, 136, 143, and 249, respectively; (59) SEQ ID NOs: 209, 103, 125, 136, 143, and 162, respectively; (60) SEQ ID NOs: 81, 391, 129, 136, 143, and 162, respectively; (61) SEQ ID NOs: 80, 109, 131, 141, 143, and 167, respectively; (62) SEQ ID NOs: 81, 107, 129, 141, 143, and 166, respectively; (63) SEQ ID NOs: 85, 113, 133, 136, 143, and 172, respectively; (64) SEQ ID NOs: 392, 393, 394, 136, 143, and 163, respectively; (65) SEQ ID NOs: 392, 395, 396, 136, 143, and 163, respectively; (66) SEQ ID NOs: 397, 398, 399, 456, 457, and 250, respectively; (67) SEQ ID NOs: 75, 400, 120, 458, 146, and 160, respectively; (68) SEQ ID NOs: 70, 401, 120, 136, 145, and 160, respectively; (69) SEQ ID NOs: 402, 403, 404, 240, 143, and 244, respectively; (70) SEQ ID NOs: 69, 219, 117, 137, 143, and 157, respectively; (71) SEQ ID NOs: 71, 405, 117, 136, 143, and 459, respectively; (72) SEQ ID NOs: 406, 407, 408, 460, 461, and 462, respectively; (73) SEQ ID NOs: 69, 90, 117, 137, 463, and 464, respectively; (74) SEQ ID NOs: 409, 410, 411, 465, 466, and 162, respectively; (75) SEQ ID NOs: 69, 219, 416, 137, 143, and 157, respectively; (76) SEQ ID NOs: 76, 412, 411, 140, 147, and 160, respectively; (77) SEQ ID NOs: 413, 414, 415, 136, 143, and 467, respectively; (78) SEQ ID NOs: 417, 418, 232, 136, 143, and 244, respectively; (79) SEQ ID NOs: 69, 419, 420, 136, 143, and 468, respectively; (80) SEQ ID NOs: 205, 421, 422, 136, 143, and 469, respectively; (81) SEQ ID NOs: 205, 423, 424, 136, 143, and 154, respectively; (82) SEQ ID NOs: 81, 391, 129, 240, 143, and 166, respectively; (83) SEQ ID NOs: 88, 425, 135, 136, 143, and 470, respectively; (84) SEQ ID NOs: 81, 426, 129, 136, 143, and 166, respectively; (85) SEQ ID NOs: 80, 109, 130, 136, 143, and 471, respectively; (86) SEQ ID NOs: 427, 428, 429, 472, 473, and 474 respectively; (87) SEQ ID NOs: 81, 391, 129, 475, 143, and 166, respectively; (88) SEQ ID NOs: 430, 391, 431, 476, 143, and 166, respectively; (89) SEQ ID NOs: 80, 109, 129, 136, 143, and 477, respectively; (90) SEQ ID NOs: 80, 391, 129, 478, 143, and 166, respectively; (91) SEQ ID NOs: 81, 432, 129, 475, 143, and 166, respectively; (92) SEQ ID NOs: 433, 391, 129, 475, 143, and 166, respectively; (93) SEQ ID NOs: 80, 109, 129, 479, 143, and 163, respectively; (94) SEQ ID NOs: 434, 435, 129, 240, 143, and 166, respectively; (95) SEQ ID NOs: 436, 428, 429, 472, 473, and 474, respectively; (96) SEQ ID NOs: 80, 437, 129, 479, 143, and 163, respectively; (97) SEQ ID NOs: 81, 391, 129, 478, 143, and 166, respectively; (98) SEQ ID NOs: 81, 438, 129, 136, 143, and 166, respectively; (99) SEQ ID NOs: 81, 391, 129, 480, 143, and 481, respectively; (100) SEQ ID NOs: 80, 439, 441, 482, 143, and 483, respectively; (101) SEQ ID NOs: 433, 391, 431, 475, 143, and 166, respectively; (102) SEQ ID NOs: 80, 442, 443, 136, 143, and 160, respectively; (103) SEQ ID NOs: 80, 440, 441, 482, 143, and 484, respectively; (104) SEQ ID NOs: 444, 445, 446, 485, 486, and 487, respectively; (105) SEQ ID NOs: 447, 448, 449, 488, 489, and 490, respectively; (106) SEQ ID NOs: 450, 451, 452, 491, 492, and 493, respectively; (107) SEQ ID NOs: 81, 453, 129, 136, 143, and 166, respectively; or (108) SEQ ID NOs: 69, 89, 454, 136, 143, and 494, respectively; or a variant thereof comprising up to about 5 amino acid substitutions in the CDRs.

In some embodiments, the CAR comprises a heavy chain variable region having an amino acid sequence set forth in any one of odd numbered SEQ ID NOs: 1-68, 251-290 and 495-680, and both odd and even numbered SEQ ID NOs: 337-345, 348-352, 355-362, 365-369, 372-374, 378-380 and 383-385, and a light chain variable region having an amino acid sequence set forth in any one of even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, the CAR comprises a heavy chain variable region and a light chain variable region having amino acid sequences set forth in (1) SEQ ID NO: 1 and 2, respectively; (2) SEQ ID NO: 3 and 4, respectively; (3) SEQ ID NO: 5 and 6, respectively; (4) SEQ ID NO: 7 and 8, respectively; (5) SEQ ID NO: 9 and 10, respectively; (6) SEQ ID NO: 11 and 12, respectively; (7) SEQ ID NO: 13 and 14, respectively; (8) SEQ ID NO: 15 and 16, respectively; (9) SEQ ID NO: 17 and 18, respectively; (10) SEQ ID NO: 19 and 20, respectively; (11) SEQ ID NO: 21 and 22, respectively; (12) SEQ ID NO: 23 and 24, respectively; (13) SEQ ID NO: 25 and 26, respectively; (14) SEQ ID NO: 27 and 28, respectively; (15) SEQ ID NO: 29 and 30, respectively; (16) SEQ ID NO: 31 and 32, respectively; (17) SEQ ID NO: 33 and 34, respectively; (18) SEQ ID NO: 35 and 36, respectively; (19) SEQ ID NO: 37 and 38, respectively; (20) SEQ ID NO: 39 and 40, respectively; (21) SEQ ID NO: 41 and 42, respectively; (22) SEQ ID NO: 43 and 44, respectively; (23) SEQ ID NO: 45 and 46, respectively; (24) SEQ ID NO: 47 and 48, respectively; (25) SEQ ID NO: 49 and 50, respectively; (26) SEQ ID NO: 51 and 52, respectively; (27) SEQ ID NO: 53 and 54, respectively; (28) SEQ ID NO: 55 and 56, respectively; (29) SEQ ID NO: 57 and 58, respectively; (30) SEQ ID NO: 59 and 60, respectively; (31) SEQ ID NO: 61 and 62, respectively; (32) SEQ ID NO: 63 and 64, respectively; (33) SEQ ID NO: 65 and 66, respectively; (34) SEQ ID NO: 67 and 68, respectively; (35) SEQ ID NO: 251 and 252, respectively; (36) SEQ ID NO: 253 and 254, respectively; (37) SEQ ID NO: 255 and 256, respectively; (38) SEQ ID NO: 257 and 258, respectively; (39) SEQ ID NO: 259 and 260, respectively; (40) SEQ ID NO: 261 and 262, respectively; (41) SEQ ID NO: 263 and 264, respectively; (42) SEQ ID NO: 265 and 266, respectively; (43) SEQ ID NO: 267 and 268, respectively; (44) SEQ ID NO: 269 and 270, respectively; (45) SEQ ID NO: 271 and 272, respectively; (46) SEQ ID NO: 273 and 274, respectively; (47) SEQ ID NO: 275 and 276, respectively; (48) SEQ ID NO: 277 and 278, respectively; (49) SEQ ID NO: 279 and 280, respectively; (50) SEQ ID NO: 281 and 282, respectively; (51) SEQ ID NO: 283 and 284, respectively; (52) SEQ ID NO: 285 and 286, respectively; (53) SEQ ID NO: 287 and 288, respectively; (54) SEQ ID NO: 289 and 290, respectively; (55) any one of SEQ ID NOs: 337-345, and SEQ ID NO.: 346, respectively; (56) any one of SEQ ID NOs: 337-345 and SEQ ID NO.: 347, respectively; (57) any one of SEQ ID NOs: 348-352 and SEQ ID Nos: 353, respectively; (58) any one of SEQ ID NOs: 348-352 and SEQ ID Nos: 354, respectively; (59) any one of SEQ ID NOs: 355-362 and SEQ ID NO: 363, respectively; (60) any one of SEQ ID NOs: 355-362 and SEQ ID NO: 364, respectively; (61) any one of SEQ ID NOs: 365-369 and SEQ ID NO: 370, respectively; (62) any one of SEQ ID NOs: 365-369 and SEQ ID NO: 371, respectively; (63) any one of SEQ ID NOs: 372-374 and any one of SEQ ID Nos: 375-377, respectively; (64) any one of SEQ ID NOs: 378-380 and SEQ ID NO: 381, respectively; (65) any one of SEQ ID NOs: 378-380 and SEQ ID NO: 382, respectively; (66) any one of SEQ ID NOs: 383-385 and SEQ ID NO: 386, respectively; (67) any one of SEQ ID NOs: 383-385 and SEQ ID NO: 387, respectively; (68) the amino acid sequences of SEQ ID NOs: 495 and 496, respectively; (69) the amino acid sequences of SEQ ID NOs: 497 and 498, respectively; (70) the amino acid sequences of SEQ ID NOs: 499 and 500, respectively; (71) the amino acid sequences of SEQ ID NOs: 501 and 502, respectively; (72) the amino acid sequences of SEQ ID NOs: 503 and 504, respectively; (73) the amino acid sequences of SEQ ID NOs: 505 and 506, respectively; (74) the amino acid sequences of SEQ ID NOs: 507 and 508, respectively; (75) the amino acid sequences of SEQ ID NOs: 509 and 510, respectively; (76)

the amino acid sequences of SEQ ID NOs: 511 and 512, respectively; (77) the amino acid sequences of SEQ ID NOs: 513 and 514, respectively; (78) the amino acid sequences of SEQ ID NOs: 515 and 516, respectively; (79) the amino acid sequences of SEQ ID NOs: 517 and 518, respectively; (80) the amino acid sequences of SEQ ID NOs: 519 and 520, respectively; (81) the amino acid sequences of SEQ ID NOs: 521 and 522, respectively; (82) the amino acid sequences of SEQ ID NOs: 523 and 524, respectively; (83) the amino acid sequences of SEQ ID NOs: 525 and 526, respectively; (84) the amino acid sequences of SEQ ID NOs: 527 and 528, respectively; (85) the amino acid sequences of SEQ ID NOs: 529 and 530, respectively; (86) the amino acid sequences of SEQ ID NOs: 531 and 532, respectively; (87) the amino acid sequences of SEQ ID NOs: 533 and 534, respectively; (88) the amino acid sequences of SEQ ID NOs: 535 and 536, respectively; (89) the amino acid sequences of SEQ ID NOs: 537 and 538, respectively; (90) the amino acid sequences of SEQ ID NOs: 539 and 540, respectively; (91) the amino acid sequences of SEQ ID NOs: 541 and 542, respectively; (92) the amino acid sequences of SEQ ID NOs: 543 and 544, respectively; (93) the amino acid sequences of SEQ ID NOs: 545 and 546, respectively; (94) the amino acid sequences of SEQ ID NOs: 547 and 548, respectively; (95) the amino acid sequences of SEQ ID NOs: 549 and 550, respectively; (96) the amino acid sequences of SEQ ID NOs: 551 and 552, respectively; (97) the amino acid sequences of SEQ ID NOs: 553 and 554, respectively; (98) the amino acid sequences of SEQ ID NOs: 555 and 556, respectively; (99) the amino acid sequences of SEQ ID NOs: 557 and 558, respectively; (100) the amino acid sequences of SEQ ID NOs: 559 and 560, respectively; (101) the amino acid sequences of SEQ ID NOs: 561 and 562, respectively; (102) the amino acid sequences of SEQ ID NOs: 563 and 564, respectively; (103) the amino acid sequences of SEQ ID NOs: 565 and 566, respectively; (104) the amino acid sequences of SEQ ID NOs: 567 and 568, respectively; (105) the amino acid sequences of SEQ ID NOs: 569 and 570, respectively; (106) the amino acid sequences of SEQ ID NOs: 571 and 572, respectively; (107) the amino acid sequences of SEQ ID NOs: 573 and 574, respectively; (108) the amino acid sequences of SEQ ID NOs: 575 and 576, respectively; (109) the amino acid sequences of SEQ ID NOs: 577 and 578, respectively; (110) the amino acid sequences of SEQ ID NOs: 579 and 580, respectively; (111) the amino acid sequences of SEQ ID NOs: 581 and 582, respectively; (112) the amino acid sequences of SEQ ID NOs: 583 and 584, respectively; (113) the amino acid sequences of SEQ ID NOs: 585 and 586, respectively; (114) the amino acid sequences of SEQ ID NOs: 587 and 588, respectively; (115) the amino acid sequences of SEQ ID NOs: 589 and 590, respectively; (116) the amino acid sequences of SEQ ID NOs: 591 and 592, respectively; (117) the amino acid sequences of SEQ ID NOs: 1593 and 594, respectively; (118) the amino acid sequences of SEQ ID NOs: 595 and 596, respectively; (119) the amino acid sequences of SEQ ID NOs: 597 and 598, respectively; (120) the amino acid sequences of SEQ ID NOs: 599 and 600, respectively; (121) the amino acid sequences of SEQ ID NOs: 601 and 602, respectively; (122) the amino acid sequences of SEQ ID NOs: 603 and 604, respectively; (123) the amino acid sequences of SEQ ID NOs: 605 and 606, respectively; (124) the amino acid sequences of SEQ ID NOs: 607 and 608, respectively; (125) the amino acid sequences of SEQ ID NOs: 609 and 610, respectively; (126) the amino acid sequences of SEQ ID NOs: 611 and 612, respectively; (127) the amino acid sequences of SEQ ID NOs: 613 and 614, respectively; (128) the amino acid sequences of SEQ ID NOs: 615 and 616, respectively; (129) the amino acid sequences of SEQ ID NOs: 617 and 618, respectively; (130) the amino acid sequences of SEQ ID NOs: 619 and 620, respectively; (131) the amino acid sequences of SEQ ID NOs: 621 and 622, respectively; (132) the amino acid sequences of SEQ ID NOs: 623 and 624, respectively; (133) the amino acid sequences of SEQ ID NOs: 625 and 626, respectively; (134) the amino acid sequences of SEQ ID NOs: 627 and 628, respectively; (135) the amino acid sequences of SEQ ID NOs: 629 and 630, respectively; (136) the amino acid sequences of SEQ ID NOs: 631 and 632, respectively; (137) the amino acid sequences of SEQ ID NOs: 633 and 634, respectively; (138) the amino acid sequences of SEQ ID NOs: 635 and 636, respectively; (139) the amino acid sequences of SEQ ID NOs: 637 and 638, respectively; (140) the amino acid sequences of SEQ ID NOs: 639 and 640, respectively; (141) the amino acid sequences of SEQ ID NOs: 641 and 642, respectively; (142) the amino acid sequences of SEQ ID NOs: 643 and 644, respectively; (143) the amino acid sequences of SEQ ID NOs: 645 and 646, respectively; (144) the amino acid sequences of SEQ ID NOs: 647 and 648, respectively; (145) the amino acid sequences of SEQ ID NOs: 649 and 650, respectively; (155) the amino acid sequences of SEQ ID NOs: 651 and 652, respectively; (156) the amino acid sequences of SEQ ID NOs: 653 and 654, respectively; (157) the amino acid sequences of SEQ ID NOs: 655 and 656, respectively; (158) the amino acid sequences of SEQ ID NOs: 657 and 658, respectively; (159) the amino acid sequences of SEQ ID NOs: 659 and 660, respectively; (160) the amino acid sequences of SEQ ID NOs: 661 and 662, respectively; (167) the amino acid sequences of SEQ ID NOs: 663 and 664, respectively; (168) the amino acid sequences of SEQ ID NOs: 665 and 666, respectively; (169) the amino acid sequences of SEQ ID NOs: 667 and 668, respectively; (170) the amino acid sequences of SEQ ID NOs: 669 and 670, respectively; (171) the amino acid sequences of SEQ ID NOs: 671 and 672, respectively; (172) the amino acid sequences of SEQ ID NOs: 673 and 674, respectively; (173) the amino acid sequences of SEQ ID NOs: 675 and 676, respectively; (174) the amino acid sequences of SEQ ID NOs:677 and 678, respectively; (175) the amino acid sequences of SEQ ID NOs: 679 and 680, respectively.

In some embodiments, the CAR comprises a heavy chain variable region and a light chain variable region having amino acid sequences set forth in (1) SEQ ID NO: 251 and 252, respectively; (2) SEQ ID NO: 253 and 254, respectively; (3) SEQ ID NO: 67 and 68, respectively; (4) SEQ ID NO: 255 and 256, respectively; (5) SEQ ID NO: 257 and 258, respectively; (6) SEQ ID NO: 43 and 44, respectively; (7) SEQ ID NO: 27 and 28, respectively; (8) SEQ ID NO: 13 and 14, respectively; (9) SEQ ID NO: 9 and 10, respectively; (10) SEQ ID NO: 3 and 4, respectively; (11) SEQ ID NO: 35 and 36, respectively; (12) SEQ ID NO: 15 and 16, respectively; (13) SEQ ID NO: 1 and 2, respectively; (14) SEQ ID NO: 17 and 18, respectively; (15) SEQ ID NO: 21 and 22, respectively; (16) SEQ ID NO: 37 and 38, respectively; (17) SEQ ID NO: 41 and 42, respectively; (18) SEQ ID NO: 259 and 260, respectively; (19) SEQ ID NO: 25 and 26, respectively; (20) SEQ ID NO: 31 and 32, respectively; (21) SEQ ID NO: 23 and 24, respectively; (22) SEQ ID NO: 261 and 262, respectively; (23) SEQ ID NO: 263 and 264, respectively; (24) SEQ ID NO: 29 and 30, respectively; (25) SEQ ID NO: 265 and 266, respectively; (26) SEQ ID NO: 267 and 268, respectively; (27) SEQ ID NO: 269 and 270, respectively; (28) SEQ ID NO: 271 and 272, respectively; (29) SEQ ID NO: 273 and 274, respectively; (30) SEQ ID NO: 275 and 276, respectively; (31) SEQ ID NO: 277 and 278, respectively; (32) SEQ ID NO: 279 and 280, respectively; (33) SEQ ID NO: 281 and 282, respectively; (34) SEQ ID NO: 283 and 284, respectively; (35) SEQ ID NO: 285 and 286, respectively; (36) SEQ ID NO: 287 and 288, respectively; or (37) SEQ ID NO: 289 and 290, respectively.

In some embodiments, the anti-Claudin18.2 scFv comprises a heavy chain variable region and a light chain variable region connected by a linker. In some embodiments, the linker is a short linker peptide of about 10 to 25 amino acids, rich in glycine as well as serine or threonine, such as one comprising an amino acid sequence of SEQ ID NO: 297. In some embodiments, the linker is connected to the N-terminus of the heavy chain variable region and the C-terminus of the light chain variable region, or vice versa. In some embodiments, the CAR comprise one or more scFvs, targeting the same or different antigens. Two scFvs in one CAR may be formed as tandem di-scFvs or diabodies, and three scFvs may be formed as tandem tri-scFvs or tri(a)bodies.

In some embodiments, the extracellular antigen binding domain further comprise at its N-terminus a signal peptide. In some embodiments, the signal peptide may be derived from a molecule selected from the group consisting of CD8a, GM-CSF receptor a, and IgG1 heavy chain. In some embodiments, the signal peptide is derived from CD8a. In some embodiments, the signal peptide comprises an amino acid sequence of SEQ ID NO: 291.

In some embodiments, the extracellular antigen binding domain further comprise, at the C-terminus, a hinge domain. In some embodiments, the hinge domain is derived from CD8a. In some embodiments, the hinge domain comprises an amino acid sequence of SEQ ID NO: 292.

In some embodiments, the transmembrane domain is derived from a molecule selected from the group consisting of CD8a, CD4, CD28, CD137, CD80, CD86, CD152 and PD1. In some embodiments, the transmembrane domain is derived from CD8a or CD28. In some embodiments, the transmembrane domain comprises an amino acid sequence of SEQ ID NO: 293.

In some embodiments, the intracellular signaling domain comprise a primary intracellular signaling domain and a co-stimulatory signaling domain. In some embodiments, the primary intracellular signaling domain is an immunoreceptor tyrosine-based activation motif (ITAM)-containing domain. In some embodiments, the ITAM-containing domain is CD3-zeta's cytoplasmic domain, which may have an amino acid sequence of SEQ ID NO: 296. In some embodiments, the co-stimulatory signaling domain is derived from a co-stimulatory molecule selected from the group consisting of CD27, CD28, CD137, OX40, CD30, CD40, CD3, LFA-1, ICOS, CD2, CD7, LIGHT, NKG2C, B7-H3, Ligands of CD83 and combinations thereof. In some embodiments, the co-stimulatory signaling domain comprises a cytoplasmic domain of CD28 and/or a cytoplasmic domain of CD137. The cytoplasmic domain of CD28 and the cytoplasmic domain of CD137 may comprise amino acid sequences of SEQ ID NO: 294 and SEQ ID NO: 295, respectively.

In some embodiments, the CAR comprises, from N-terminus to C-terminus, in turn a signal peptide of SEQ ID NO:291, a light chain variable region and a heavy chain variable region described above for the Claudin18.2 binding moieties connected with a linker of SEQ ID NO: 297, a linker of SEQ ID NO: 298, a hinge of SEQ NO: 292, a CD137 cytoplasmic domain of SEQ ID NO: 294, and a CD3-zeta's cytoplasmic domain of SEQ ID NO: 296.

In some embodiments, the CAR comprises an amino acid sequence having at least 80%, at least 85%, at least 90%, at least 95%, or at least 98% sequence identity to an amino acid sequence of any one of SEQ ID NOs: 299-335. In some embodiments, the CAR comprises an amino acid sequence of any one of SEQ ID NOs: 299-335.

The present application provides nucleic acids encoding the CARs described herein. The present application also provides a vector comprising any one of the isolated nucleic acids described above. In some embodiments, the vector is an expression vector. In some embodiments, the vector is a viral vector, a lentiviral vector or a non-viral vector.

The present application provides an engineered immune cell, comprising any one of the CARs provided above, or any one of the isolated nucleic acids described above, or any one of the vectors described above. In some embodiments, the immune cell is a T cell, an NK cell, a peripheral blood mononuclear cell (PBMC), a hematopoietic stem cell, a pluripotent stem cell, or an embryonic stem cell. In some embodiments, the immune cell is a T cell, such as a cytotoxic T cell, a helper T cell, a natural killer T cell, or a γδT cell.

In some embodiments, provided herein are pharmaceutical compositions comprising a therapeutically effective amount of the binding moieties described herein or the CARs provided above, and a pharmaceutically acceptable carrier.

Also provided herein are methods of treating a Claudin18.2-expressing tumor or cancer in a subject in need thereof, by administering to the subject a therapeutically effective amount of the pharmaceutical composition described herein.

In some embodiments, the Claudin18.2-expressing tumor or cancer is gastric, esophageal, gastroesophageal, pancreatic, ovarian, or lung tumor or cancer. In some embodiments, the Claudin18.2-expressing tumor or cancer is a gastric tumor or cancer. In some embodiments, the Claudin18.2-expressing tumor or cancer is a gastroesophageal tumor or cancer.

In some embodiments, the subject is human.

In some embodiments, the engineered immune cell for treating the tumor or cancer is autologous. In some embodiments, the engineered immune cell is allogenic.

BRIEF DESCRIPTION OF THE DRAWINGS

FIGS. 1A-1O depict binding capacities of indicated antibodies to Claudin18.2-His protein by indirect ELISA, plotted against the log of antibody concentration (ng/ml).

FIGS. 2A-2P depict lysis of human Claudin18.2-overexpressing CHO-K1 target cells following incubation with indicated antibodies. IMAB362 (Claudiximab) antibody was used as a positive control. Results are plotted as percent of target cell lysis as a function of log antibody concentration (μg/ml).

FIGS. 3A-3Q depict binding of indicated antibodies to a Claudin18.2-expressing HEK293T stable cell line, plotted against the log of antibody concentration (nmol/L). IMAB362 (Claudiximab), mouse IgG and human IgG1Fc served as controls.

FIGS. 4A-4C depict the binding of indicated chimeric antibody to Claudin18.2-expressing HEK293 cells as a function of the log of antibody concentration (nM). IMAB362 (Claudiximab) and human IgG served as controls.

FIGS. 5A-5C depict lysis of human Claudin18.2-overexpressing CHO-K1 target cells following incubation with indicated chimeric antibodies. Results are plotted as percent of target cell lysis as a function of log antibody concentration (μg/ml). IMAB362 (Claudiximab) and human IgG served as controls.

FIGS. 6A-6G depict percent lysis of human Claudin18.2-overexpressing CHO-K1 target cells following incubation with indicated antibodies and freshly isolated human PBMCs. Results are plotted as percent of target cell lysis as a function of log antibody concentration (μg/ml). IMAB362 (Claudiximab) and human IgG served as controls.

FIGS. 7A-7G depict the binding of indicated humanized antibody to Claudin18.2-expressing HEK293 cells as a function of the log of antibody concentration (nM). IMAB362 (Claudiximab) and human IgG served as controls.

FIGS. 8A-8H depict lysis of human Claudin18.2-overexpressing CHO-K1 target cells following incubation with indicated chimeric antibodies. Results are plotted as percent of target cell lysis as a function of log antibody concentration (μg/ml). IMAB362 (Claudiximab) and human IgG served as controls.

FIGS. 9A-9H depict percent lysis of human Claudin18.2-overexpressing CHO-K1 target cells following incubation with indicated antibodies and freshly isolated human PBMCs. Results are plotted as percent of target cell lysis as a function of log antibody concentration (μg/ml). IMAB362 (Claudiximab) and human IgG served as controls.

DETAILED DESCRIPTION OF THE INVENTION

Definitions

Figure 1A:
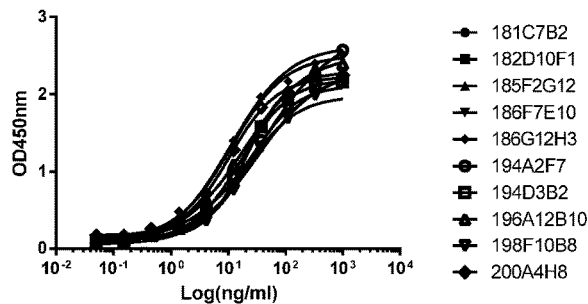
FIGS. 1A-1O. Non-humanized Claudin18.2 antibody ELISA Assay.
Figure 1B:
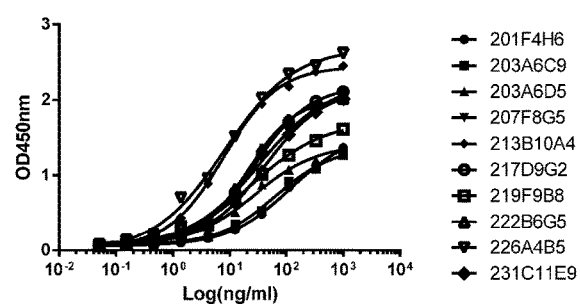
Figure 1C:
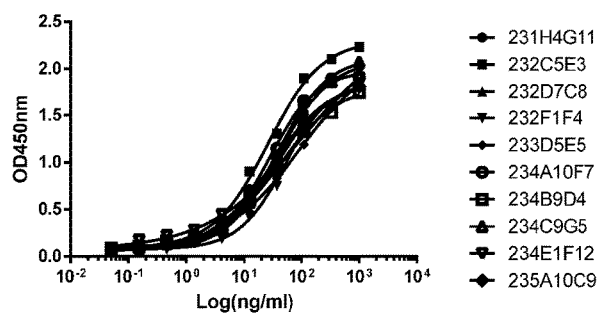
Figure 1D:
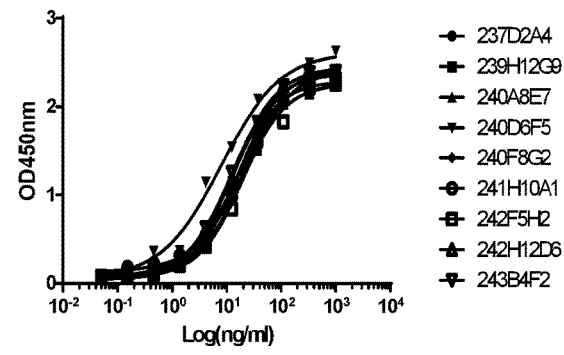
Figure 1E:
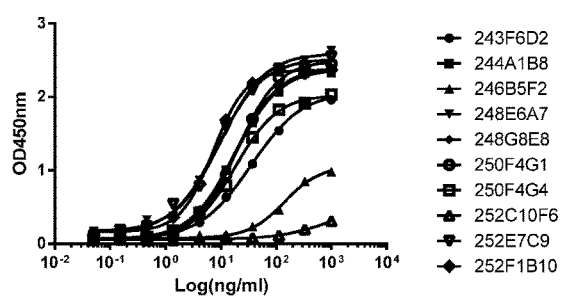
Figure 1F:
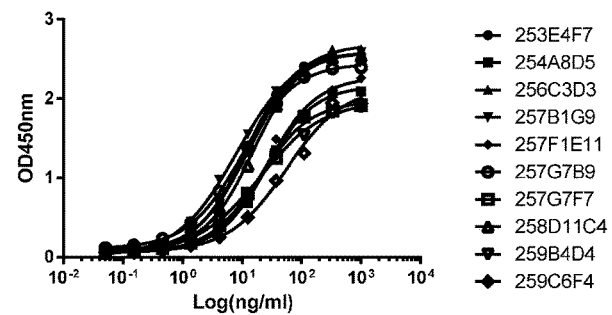
Figure 1G:
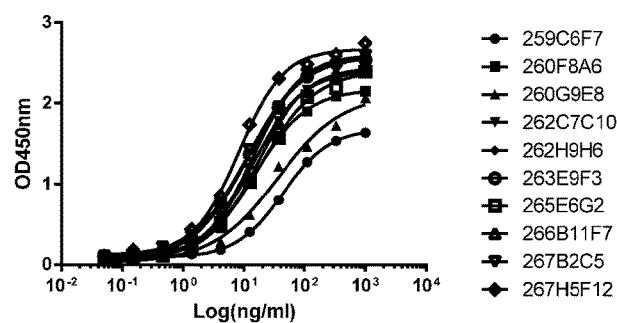
Figure 1H:
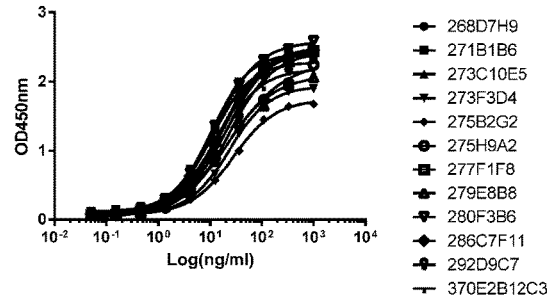
Figure 1I:
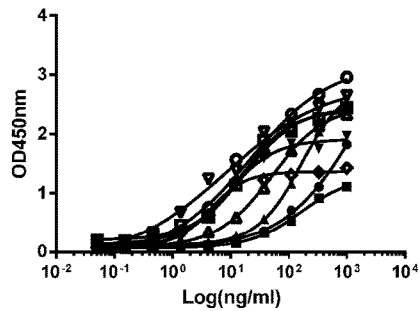
Figure 1J:
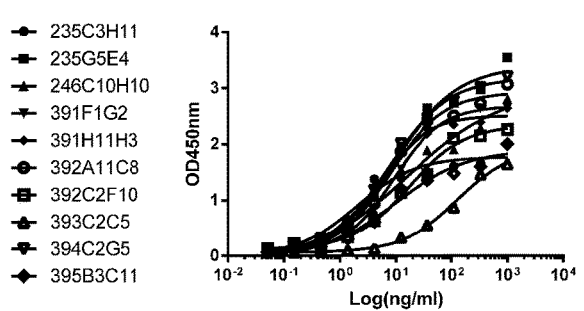
Figure 1K:
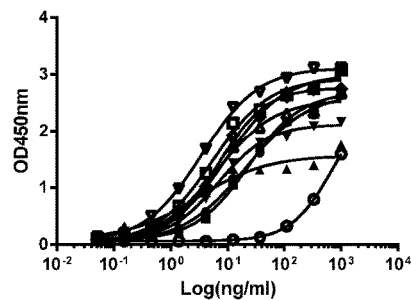
Figure 1L:
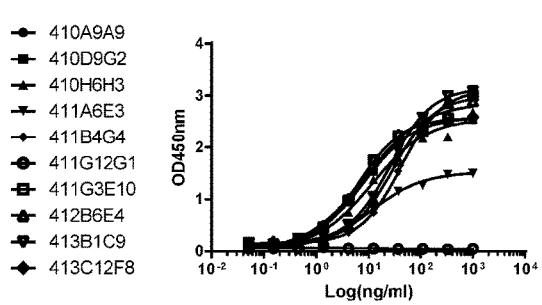
Figure 1M:
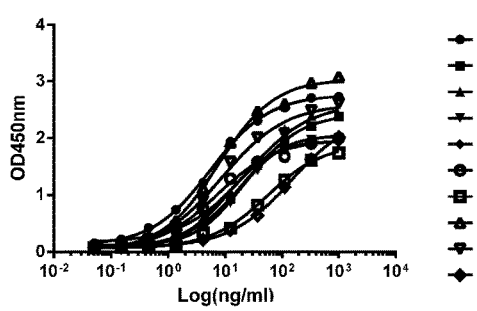
Figure 1N:
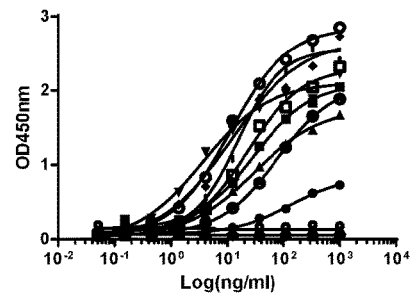

Unless otherwise defined herein, technical and scientific terms used in the present description have the meanings that are commonly understood by those of ordinary skill in the art.

The terms "a" and "an" as used herein refer to one or to more than one (i.e., to at least one) of the grammatical object of the article. By way of example, "an antibody" means one antibody or more than one antibody.

The term "binding moiety" as used herein refers to a molecule or a portion of a molecule which binds a target molecule (e.g., Claudin18.2). A binding moiety can comprise a protein, peptide, nucleic acid, carbohydrate, lipid, or small molecular weight compound. In some embodiments, the binding moiety comprises an antibody. In some embodiments, a binding moiety comprises an antigen-binding fragment of an antibody. In some embodiments, a binding moiety comprises a small molecular weight component. The binding moiety can also be an antibody or an antigen-binding fragment thereof. In some embodiments, a binding moiety comprises the ligand-binding domain of a receptor. In some embodiments, a binding moiety comprises the extracellular domain of a transmembrane receptor. The binding moiety can also be the ligand-binding domain of a receptor, or the extracellular domain of a transmembrane receptor. A binding moiety can be monovalent, which means that it contains one binding site that specifically interacts with the target molecule. A binding moiety can also be bivalent, meaning that it contains two binding sites that specifically interact with the target molecule. A binding moiety can also be multivalent, meaning that is contains multiple binding sites that specifically interact with the target molecule. A bivalent binding moiety or multivalent binding moiety can interact with one or more epitopes on a single target molecule. A bivalent binding moiety or multivalent binding moiety can also interact with two or more target molecules.

The term "binding affinity" as used herein generally refers to the strength of the sum total of noncovalent interactions between a binding moiety and a target molecule. The binding of a binding moiety and a target molecule is a reversible process, and the affinity of the binding is typically reported as an equilibrium dissociation constant ($K_D$). $K_D$ is the ratio of a dissociation rate ($k_{off}$ or $k_d$) to the association rate ($k_{on}$, or $k_a$). The lower the $K_D$ of a binding pair, the higher the affinity. A variety of methods of measuring binding affinity are known in the art, any of which can be used for purposes of the present disclosure. Specific illustrative embodiments include the following. In one embodiment, the "$K_D$" or "$K_D$ value" can be measured by assays known in the art, for example by a binding assay. The $K_D$ may be measured in a radiolabeled antigen binding assay (RIA) (Chen, et al., (1999) *J. Mol Biol* 293:865-881). The $K_D$ or $K_D$ value may also be measured by using surface plasmon resonance assays by Biacore, using, for example, a BIAcore™-2000 or a BIAcore™-3000 BIAcore, Inc., Piscataway, N.J.), or by biolayer interferometry using, for example, the OctetQK384 system (ForteBio, Menlo Park, Calif.). When a target molecule containing multiple epitopes come in contact with a binding moiety containing multiple binding sites that bind the target molecule, the interaction of the binding molecule with the target molecule at one site will increase the probability of a reaction at a second site. The strength of such multiple interactions between a multivalent antibody and antigen is called the avidity. For example, high avidity can compensate for low affinity as is sometimes found for pentameric IgM antibodies, which can have a lower affinity than IgG, but the high avidity of IgM, resulting from its multivalence, enables it to bind antigen effectively.

The term "specifically binds," as used herein, means that a polypeptide or molecule interacts more frequently, more rapidly, with greater duration, with greater affinity, or with some combination of the above to the epitope, protein, or target molecule than with alternative substances, including related and unrelated proteins. A binding moiety (e.g. antibody) that specifically binds a target molecule (e.g. antigen) can be identified, for example, by immunoassays, ELISAs, SPR (e.g., Biacore), or other techniques known to those of skill in the art. Typically, a specific reaction will be at least twice background signal or noise and can be more than 10 times background. See, e.g., Paul, ed., 1989, Fundamental Immunology Second Edition, Raven Press, New York at pages 332-336 for a discussion regarding antibody specificity. A binding moiety that specifically binds a target molecule can bind the target molecule at a higher affinity than its affinity for a different molecule. In some embodiments, a binding moiety that specifically binds a target molecule can bind the target molecule with an affinity that is at least 20 times greater, at least 30 times greater, at least 40 times greater, at least 50 times greater, at least 60 times greater, at least 70 times greater, at least 80 times greater, at least 90 times greater, or at least 100 times greater, than its affinity for a different molecule. In some embodiments, a binding moiety that specifically binds a particular target molecule binds a different molecule at such a low affinity that binding cannot be detected using an assay described herein or otherwise known in the art. In some embodiments, "specifically binds" means, for instance, that a binding moiety binds a molecule target with a $K_D$ of about 0.1 mM or less. In some embodiments, "specifically binds" means that a polypeptide or molecule binds a target with a $K_D$ of at about 10 µM or less or about 1 µM or less. In some embodiments, "specifically binds" means that a polypeptide or molecule binds a target with a $K_D$ of at about 0.1 µM or less, about 0.01 µM or less, or about 1 nM or less. Because of the sequence identity between homologous proteins in different species, specific binding can include a polypeptide or molecule that recognizes a protein or target in more than one species. Likewise, because of homology within certain regions of polypeptide sequences of different proteins, specific binding can include a polypeptide or molecule that recognizes more than one protein or target. It is understood that, in some embodiments, a binding moiety that specifically binds a first target may or may not specifically bind a second target. As such, "specific binding" does not necessarily require (although it can include) exclusive binding, i.e., binding to a single target. Thus, a binding moiety can, in some embodiments, specifically bind more than one target. For example, an antibody can, in certain instances, comprise two identical antigen-binding sites, each of which specifically binds the same epitope on two or more proteins. In certain alternative embodiments, an antibody can be bispecific and comprise at least two antigen-binding sites with differing specificities.

The term "antibody" as used herein refers to an immunoglobulin molecule that recognizes and specifically binds a target, such as a protein, polypeptide, peptide, carbohydrate, polynucleotide, lipid, or a combination of any of the foregoing, through at least one antigen-binding site wherein the antigen-binding site is usually within the variable region of the immunoglobulin molecule. As used herein, the term encompasses intact polyclonal antibodies, intact monoclonal antibodies, single-chain Fv (scFv) antibodies, light chain antibodies (LCAbs), multispecific antibodies, bispecific antibodies, monospecific antibodies, monovalent antibodies, fusion proteins comprising an antigen-binding site of an antibody, and any other modified immunoglobulin molecule comprising an antigen-binding site (e.g., dual variable domain immunoglobulin molecules) as long as the antibodies exhibit the desired biological activity. Antibodies also include, but are not limited to, mouse antibodies, chimeric antibodies, humanized antibodies, and human antibodies. An antibody can be any of the five major classes of immunoglobulins: IgA, IgD, IgE, IgG, and IgM, or subclasses (isotypes) thereof (e.g., IgG1, IgG2, IgG3, IgG4, IgA1 and IgA2), based on the identity of their heavy-chain constant domains referred to as alpha, delta, epsilon, gamma, and mu, respectively. The different classes of immunoglobulins have different and well-known subunit structures and three-dimensional configurations. Antibodies can be naked or conjugated to other molecules, including but not limited to, toxins and radioisotopes. Unless expressly indicated otherwise, the term "antibody" as used herein include "antigen-binding fragments" of intact antibodies.

The term "antigen-binding fragment" as used in connection with an antibody refers to a portion of an intact antibody and refers to the antigenic determining variable regions of an intact antibody. Examples of antibody fragments include, but are not limited to, Fab, Fab', F(ab')$_2$, Fv, linear antibodies, single chain antibody molecules (e.g., scFv), light chain antibodies (LCAbs), disulfide-linked scFv (dsscFv), diabodies, tribodies, tetrabodies, minibodies, dual variable domain antibodies (DVD), and multispecific antibodies formed from antibody fragments.

The term "variable region" of an antibody as used herein refers to the variable region of an antibody light chain, or the variable region of an antibody heavy chain, either alone or in combination. Generally, the variable region of heavy and light chains each consist of four framework regions (FRs) and three complementarity determining regions (CDRs), also known as "hypervariable regions." The CDRs in each chain are held together in close proximity by the framework regions and, with the CDRs from the other chain, contribute to the formation of the antigen-binding sites of the antibody. There are at least two techniques for determining CDRs: (1) an approach based on cross-species sequence variability (Kabat et al., 1991, Sequences of Proteins of Immunological Interest (5 ed.). Bethesda, Md.: National Institutes of Health), and (2) an approach based on crystallographic studies of antigen-antibody complexes (Al-Lazikani et al., 1997, *J. Mol. Biol.*, 273(4):927-48). In addition, combinations of these two approaches are used in the art and can be used to determine CDRs.

The term "single chain variable fragment" or "scFv" refers to a fusion protein of the heavy chain variable region and light chain variable region of immunoglobulins, connected with a short linker peptide of ten to twenty-five amino acids. The linker is usually rich in glycine for flexibility, as well as serine or threonine for solubility. The scFv retains the specificity of the original immunoglobulin. The scFvs can be linkered by linkers of different lengths to form di-scFvs, diabodies, tri-scFvs, triabodies, or tetrabodies, which may show specificity to one or more antigens.

The term "chimeric antigen receptor" or "CAR" refers to an engineered receptor that grafts a defined specificity onto an immune effector cell, typically a T cell, and augments T-cell function. The new generation CAR comprises an extracellular binding domain comprising a scFv, a hinge region, a transmembrane domain, and an intracellular signaling domain (mainly CD3-zeta's cytoplasmic domain, which is the primary transmitter of T cell activation signals, plus one or more co-stimulatory domains). The CARs may further add factors that enhance T cell expansion, persistence, and anti-tumor activity, such as cytokines and co-stimulatory ligands.

The term "autologous" is meant to refer to any material derived from the same individual to whom it is later to be re-introduced into the individual.

The term "Allogeneic" refers to a graft derived from a different individual of the same species.

The term "humanized antibody" as used herein refers to forms of non-human (e.g., murine) antibodies that are specific immunoglobulin chains, chimeric immunoglobulins, or fragments thereof that contain minimal non-human sequences. Typically, humanized antibodies are human immunoglobulin. In some instances, the Fv framework region residues of a human immunoglobulin are replaced with the corresponding residues in an antibody from a non-human species. In some instances, residues of the CDRs are replaced by residues from the CDRs of a non-human species (e.g., mouse, rat, hamster) that have the desired specificity, affinity, and/or binding capability. The humanized antibody can be further modified by the substitution of additional residues either in the Fv framework region and/or within the replaced non-human residues to refine and optimize antibody specificity, affinity, and/or binding capability. The humanized antibody can comprise variable domains containing all or substantially all of the CDRs that correspond to the non-human immunoglobulin whereas all or substantially all of the framework regions are those of a human immunoglobulin sequence. In some embodiments, the variable domains comprise the framework regions of a human immunoglobulin sequence. In some embodiments, the variable domains comprise the framework regions of a human immunoglobulin consensus sequence. The humanized antibody can also comprise at least a portion of an immunoglobulin constant region or domain (Fc), typically that of a human immunoglobulin. A humanized antibody is usually considered distinct from a chimeric antibody.

The term "chimeric antibody" as used herein refers to an antibody wherein the amino acid sequence of the immunoglobulin molecule is derived from two or more species. Typically, the variable region of both light and heavy chains corresponds to the variable region of antibodies derived from one species of mammals (e.g., mouse, rat, rabbit, etc.) with the desired specificity, affinity, and/or binding capability, while the constant regions are homologous to the sequences in antibodies derived from another species (usually human) to avoid eliciting an immune response in that species.

The term "human antibody" as used herein refers to an antibody produced by a human or an antibody having an amino acid sequence corresponding to an antibody produced by a human made using any of the techniques known in the art.

The terms "epitope" and "antigenic determinant" are used interchangeably herein refer to the site on the surface of a target molecule to which a binding moiety binds, such as a localized region on the surface of an antigen. The target molecule can comprise, a protein, a peptide, a nucleic acid, a carbohydrate, or a lipid. An epitope having immunogenic activity is a portion of a target molecule that elicits an immune response in an animal. An epitope of a target molecule having antigenic activity is a portion of the target molecule to which an antibody binds, as determined by any method well known in the art, including, for example, by an immunoassay. Antigenic epitopes need not necessarily be immunogenic. Epitopes often consist of chemically active surface groupings of molecules such as amino acids or sugar side chains and have specific three dimensional structural characteristics as well as specific charge characteristics. The term, "epitope" includes linear epitopes and conformational epitopes. A region of a target molecule (e.g. a polypeptide) contributing to an epitope may be contiguous amino acids of the polypeptide or the epitope may come together from two or more non-contiguous regions of the target molecule. The epitope may or may not be a three-dimensional surface feature of the target molecule. Epitopes formed from contiguous amino acids (also referred to as linear epitopes) are typically retained upon protein denaturing, whereas epitopes formed by tertiary folding (also referred to as conformational epitopes) are typically lost upon protein denaturing. An epitope typically includes at least 3, and more usually, at least 5, 6, 7, or 8-10 amino acids in a unique spatial conformation.

The terms "polypeptide," "peptide," and "protein" as used interchangeably herein refer to polymers of amino acids of any length, which can be linear or branched. It can include unnatural or modified amino acids, or be interrupted by non-amino acids. A polypeptide, peptide, or protein, can also be modified with, for example, disulfide bond formation, glycosylation, lipidation, acetylation, phosphorylation, or any other manipulation or modification.

The terms "polynucleotide" and "nucleic acid" as used interchangeably herein refer to polymers of nucleotides of any length, and include DNA and RNA. The nucleotides can be deoxyribonucleotides, ribonucleotides, modified nucleotides or bases, and/or their analogs, or any substrate that can be incorporated into a polymer by DNA or RNA polymerase.

A polypeptide, peptide, protein, antibody, polynucleotide, vector, cell, or composition which is "isolated" is a polypeptide, peptide, protein, antibody, polynucleotide, vector, cell, or composition which is in a form not found in nature. Isolated polypeptides, peptides, proteins, antibodies, polynucleotides, vectors, cells, or compositions include those which have been purified to a degree that they are no longer in a form in which they are found in nature. In some embodiments, a polypeptide, peptide, protein, antibody, polynucleotide, vector, cell, or composition which is isolated is substantially pure.

The terms "identical" or percent "identity" as used herein in the context of two or more nucleic acids or polypeptides, refer to two or more sequences or subsequences that are the same or have a specified percentage of nucleotides or amino acid residues that are the same, when compared and aligned (introducing gaps, if necessary) for maximum correspondence, not considering any conservative amino acid substitutions as part of the sequence identity. The percent identity can be measured using sequence comparison software or algorithms or by visual inspection. Various algorithms and software that can be used to obtain alignments of amino acid or nucleotide sequences are well-known in the art. These include, but are not limited to, BLAST, ALIGN, Megalign, BestFit, GCG Wisconsin Package, and variants thereof. In some embodiments, two nucleic acids or polypeptides of the invention are substantially identical, meaning they have at least 70%, at least 75%, at least 80%, at least 85%, at least 90%, and in some embodiments at least 95%, 96%, 97%, 98%, 99% nucleotide or amino acid residue identity, when compared and aligned for maximum correspondence, as measured using a sequence comparison algorithm or by visual inspection. In some embodiments, identity exists over a region of the amino acid sequences that is at least about 10 residues, at least about 20 residues, at least about 40-60 residues, at least about 60-80 residues in length or any integral value there between. In some embodiments, identity exists over a longer region than 60-80 residues, such as at least about 80-100 residues, and in some embodiments the sequences are substantially identical over the full length of the sequences being compared, such as the coding region of a target protein or an antibody. In some embodiments, identity exists over a region of the nucleotide sequences that is at least about 10 bases, at least about 20 bases, at least about 40-60 bases, at least about 60-80 bases in length or any integral value there between. In some embodiments, identity exists over a longer region than 60-80 bases, such as at least about 80-1000 bases or more, and in some embodiments the sequences are substantially identical over the full length of the sequences being compared, such as a nucleotide sequence encoding a protein of interest.

The term "amino acid substitution," as used herein, refers to the replacement of one amino acid residue with another in a polypeptide sequence. A "conservative amino acid substitution" is one in which one amino acid residue is replaced with another amino acid residue having a side chain with similar chemical characteristics. Families of amino acid residues having similar side chains have been generally defined in the art, including basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). For example, substitution of a phenylalanine for a tyrosine is a conservative substitution. Generally, conservative substitutions in the sequences of the polypeptides, soluble proteins, and/or antibodies of the disclosure do not abrogate the binding of the polypeptide, soluble protein, or antibody containing the amino acid sequence, to the target binding site. Methods of identifying amino acid conservative substitutions which do not eliminate binding are well-known in the art.

The term "variant" as used herein in relation to a binding moiety (e.g. an antibody) having a polypeptide with particular sequence features (the "reference binding moiety") refers to a different binding moiety having a polypeptide comprising one or more (such as, for example, about 1 to about 25, about 1 to about 20, about 1 to about 15, about 1 to about 10, or about 1 to about 5) amino acid sequence substitutions, deletions, and/or additions as compared to the reference binding moiety. An anti-Claudin18.2-binding moiety variant or anti-Claudin18.2 antibody variant at least retains specific binding to Claudin18.2. In some embodiments, a binding moiety variant can result from one or more (such as, for example, about 1 to about 25, about 1 to about 20, about 1 to about 15, about 1 to about 10, or about 1 to about 5) changes to an amino acid sequence of a reference binding moiety. Also by way of example, a variant of an anti-Claudin18.2 antibody can result from one or more (such as, for example, about 1 to about 25, about 1 to about 20, about 1 to about 15, about 1 to about 10, or about 1 to about 5) changes to an amino acid sequence of a reference anti-Claudin18.2 antibody. The changes to an amino acid sequence can be amino acid substitutions. In some embodiments, the changes to an amino acid sequence can be conservative amino acid substitutions. In some embodiments, an anti-Claudin18.2-binding moiety variant or anti-Claudin18.2 antibody variant can result from one or more (such as, for example, about 1 to about 25, about 1 to about 20, about 1 to about 15, about 1 to about 10, or about 1 to about 5) amino acid substitutions in the VH or VL regions or subregions, such as one or more CDRs. In some embodiments, an anti-Claudin18.2-binding moiety variant or anti-Claudin18.2 antibody variant can result from one, up to two, up to three, up to four, or up to five amino acid substitutions in each of the VH or VL region. In some embodiments, an anti-Claudin18.2-binding moiety variant or anti-Claudin18.2 antibody variant can result from one, up to two, up to three, up to four, or up to five amino acid substitutions in each of the CDRs region.

The term "vector" refers to a substance that is used to carry or include a nucleic acid sequences, including for example, in order to introduce a nucleic acid sequence into a host cell. Vectors applicable for use include, for example, expression vectors, plasmids, phage vectors, viral vectors, episomes and artificial chromosomes, which can include selection sequences or markers operable for stable integration into a host cell's chromosome. Additionally, the vectors can include one or more selectable marker genes and appropriate expression control sequences. Selectable marker genes that can be included, for example, provide resistance to antibiotics or toxins, complement auxotrophic deficiencies, or supply critical nutrients not in the culture media. Expression control sequences can include constitutive and inducible promoters, transcription enhancers, transcription terminators, and the like which are well known in the art. When two or more nucleic acid molecules are to be co-expressed (e.g. both an antibody heavy and light chain or an antibody VH and VL) both nucleic acid molecules can be inserted, for example, into a single expression vector or in separate expression vectors. For single vector expression, the encoding nucleic acids can be operationally linked to one common expression control sequence or linked to different expression control sequences, such as one inducible promoter and one constitutive promoter. The introduction of nucleic acid molecules into a host cell can be confirmed using methods well known in the art. It is understood by those skilled in the art that the nucleic acid molecules are expressed in a sufficient amount to produce a desired product (e.g. an anti-Claudin18.2 antibody as described herein), and it is further understood that expression levels can be optimized to obtain sufficient expression using methods well known in the art.

The term "subject" refers to any animal (e.g., a mammal), including, but not limited to, humans, non-human primates, canines, felines, rodents, and the like, which is to be the recipient of a particular treatment. In some embodiments, a subject is a human. A "subject" can be a patient with a particular disease. In some embodiments, a subject is a patient having a Claudin 18.2-expressing cancer or tumor.

The term "treat" as used herein in connection with a disease or a condition, or a subject having a disease or a condition refers to an action that suppresses, eliminates, reduces, and/or ameliorates a symptom, the severity of the symptom, and/or the frequency of the symptom associated with the disease or disorder being treated. When used in reference to a cancer or tumor, the term "treat" refers to an action that reduces the severity of the cancer or tumor, or retards or slows the progression of the cancer or tumor, including (a) inhibiting the growth, or arresting development of the cancer or tumor, or (b) causing regression of the cancer or tumor, or (c) delaying, ameliorating or minimizing one or more symptoms associated with the presence of the cancer or tumor.

The term "administer," "administering," or "administration" as used herein refers to the act of delivering, or causing to be delivered, a therapeutic or a pharmaceutical composition to the body of a subject by a method described herein or otherwise known in the art. The therapeutic can be a compound, a polypeptide, a cell, or a population of cells. Administering a therapeutic or a pharmaceutical composition includes prescribing a therapeutic or a pharmaceutical composition to be delivered into the body of a patient. Exemplary forms of administration include oral dosage forms, such as tablets, capsules, syrups, suspensions; injectable dosage forms, such as intravenous (IV), intramuscular (IM), or intraperitoneal (IP); transdermal dosage forms, including creams, jellies, powders, or patches; buccal dosage forms; inhalation powders, sprays, suspensions, and rectal suppositories.

The term "therapeutically effective amount" as used herein refers to an amount of a compound, polypeptide, cell, formulation, material, or composition, as described herein sufficient to provide a therapeutic benefit in the treatment of the disease or disorder or to delay or minimize one or more symptoms associated with the disease or disorder. The disease or disorder can be a Claudin18.2-expressing cancer or tumor.

As used herein, the term "carrier" include "pharmaceutically acceptable carriers," excipients, or stabilizers that are nontoxic to the cell or mammal being exposed thereto at the dosages and concentrations employed. The term "carrier" can also refer to a diluent, adjuvant (e.g., Freund's adjuvant (complete or incomplete)), excipient, or vehicle with which therapeutic is administered. Examples of suitable pharmaceutical carriers are described in Remington's Pharmaceutical Sciences (1990) Mack Publishing Co., Easton, Pa. Compositions, including pharmaceutical compounds, may contain a prophylactically or therapeutically effective amount of an anti-beta klotho antibody, for example, in isolated or purified form, together with a suitable amount of carrier so as to provide the form for proper administration to the subject (e.g., patient). The formulation should suit the mode of administration.

Claudin18.2-Binding Moieties

Claudin18.2 is isoform 2 of Claudin18, a member of the Claudin family of cell surface proteins. Claudins are important components of the tight cell junctions, forming a paracellular barrier which controls the flow of molecules between the cells. Different claudins are expressed on different tissues, and their altered function has been linked to the formation of cancers of these tissues. In normal tissue, the expression of Claudin-18.2 is limited to the epithelial cells of the gastric mucosa. Claudin18.2 expression is retained upon malignant transformation in gastric cancer and its metastases. Ectopic activation of claudin 18.2 has also been found in pancreatic, esophageal, ovarian, and lung tumors.

The human Claudin18.2 protein has 261 amino acids (NCBI, NP 001002026.1; SEQ ID NO: 200). Claudin18.2 exists as a tetraspan transmembrane protein, with a N-terminus and a C-terminus in the cytoplasm. Claudin18.2 has two extracellular loops, which have been linked to functions such as tightening of the paracellular cleft for solutes, and the formation paracellular ion pores.

```
                                            (SEQ ID NO: 200)
MAVTACQGLG  FVVSLIGIAG  IIAATCMDQW  STQDLYNNPV

TAVFNYQGLW  RSCVRESSGF  TECRGYFTLL  GLPAMLQAVR

ALMIVGIVLG  AIGLLVSIFA  LKCIRIGSME  DSAKANMTLT

SGIMFIVSGL  CAIAGVSVFA  NMLVTNFWMS  TANMYTGMGG

MVQTVQTRYT  FGAALFVGWV  AGGLTLIGGV  MMCIACRGLA

PEETNYKAVS  YHASGHSVAY  KPGGFKASTG  FGSNTKNKKI

YDGGARTEDE  VQSYPSKHDY  V
```

The Claudin18.2-binding moiety specifically binds Claudin18.2, a fragment thereof, or a variant thereof. In some embodiments, a Claudin18.2-binding moiety specifically binds human Claudin18.2. In some embodiments, a Claudin18.2-binding moiety specifically binds an extracellular domain of Claudin18.2. In some embodiments, a Claudin18.2-binding moiety specifically binds the first extracellular loop of Claudin18.2. In some embodiments, a Claudin18.2-binding moiety specifically binds the second extracellular loop of Claudin18.2. In some embodiments, a Claudin18.2-binding moiety specifically binds both the first and the second extracellular loops of Claudin18.2. In some embodiments, the Claudin18.2-binding moiety binds Claudin18.2 with an affinity that is at least 20-fold greater than the antibody's affinity to Claudin 18.1. In some embodiments, the Claudin18.2-binding moiety binds Claudin18.2 with an affinity that is at least 50-fold greater than the antibody's affinity to Claudin18.1. In some embodiments, the Claudin18.2-binding moiety binds Claudin18.2 with an affinity that is at least 100-fold greater than the antibody's affinity to Claudin18.1. In some embodiments, the Claudin18.2-binding moiety does not detectably bind Claudin18.1.

The antibody can be a Fab, a Fab', a F(ab')$_2$, a Fv, a scFv, a (scFv)$_2$, an IgG1 antibody, an IgG2 antibody, an IgG3 antibody, or an IgG4 antibody.

In some embodiments, a Claudin18.2-binding moiety comprises an antibody. In some embodiments, a Claudin18.2-binding moiety comprises an antigen-binding fragment of an antibody. In some embodiments, the antibody is an IgA, IgD, IgE, IgG, or IgM antibody. In some embodiments, the antibody is an IgA antibody. In some embodiments, the antibody is an IgD antibody. In some embodiments, the antibody is an IgE antibody. In some embodiments, the antibody is an IgG antibody. In some embodiments, the antibody is an IgM antibody. In some embodiments, the antibody is an IgG1 antibody. In some embodiments, the antibody is an IgG2 antibody. In some embodiments, the antibody is an IgG3 antibody. In some embodiments, the antibody is an IgG4 antibody.

In some embodiments, a Claudin18.2-binding moiety comprises a Fab. In some embodiments, the antibody is a Fab'. In some embodiments, a Claudin18.2-binding moiety comprises a F(ab')$_2$. In some embodiments, a Claudin18.2-binding moiety comprises a Fv. In some embodiments, a Claudin18.2-binding moiety comprises a scFv. In some embodiments a Claudin18.2-binding moiety comprises a disulfide-linked scFv [(scFv)$_2$]. In some embodiments, a Claudin18.2-binding moiety comprises a diabody (dAb).

In some embodiments, a Claudin18.2-binding moiety comprises a recombinant antibody. In some embodiments, a Claudin18.2-binding moiety comprises a monoclonal antibody. In some embodiments, a Claudin18.2-binding moiety comprises a polyclonal antibody. In some embodiments, a Claudin18.2-binding moiety comprises a chimeric antibody. In some embodiments, a Claudin18.2-binding moiety comprises a humanized antibody. In some embodiments, a Claudin18.2-binding moiety comprises a human antibody.

In some embodiments, the antibody is isolated. In some embodiments, the antibody is substantially pure.

In some embodiments, a Claudin18.2-binding moiety comprises a bispecific binding moiety. In some embodiments, a Claudin18.2-binding moiety comprises a multispecific binding moiety.

In some embodiments, a Claudin18.2-binding moiety (e.g. antibody) comprises a monovalent binding moiety. In some embodiments, a Claudin18.2-binding moiety (e.g. antibody) comprises a monospecific binding moiety. In some embodiments, a Claudin18.2-binding moiety (e.g. antibody) comprises a bivalent binding moiety. In some embodiments, the bivalent binding moiety comprises two antibodies. In some embodiments, the bivalent binding moiety comprises a first antibody and a second antibody. In some embodiments, the first antibody and the second antibody are connected by a linker. In some embodiments, a Claudin18.2-binding moiety (e.g. antibody) comprises a first antibody, a linker and a second antibody, from N-terminus to C-terminus. In some embodiments, the second antibody is a tandem repeat of the first antibody. In some embodiments, the first antibody and the second antibody recognize different epitopes on Claudin18.2. In some embodiments, the first antibody and the second antibody recognize the same epitope on Claudin18.2.

In some embodiments, a Claudin18.2-binding moiety is a monoclonal antibody. Monoclonal antibodies can be prepared by any method known to those of skill in the art. One exemplary approach is screening protein expression libraries, e.g., phage or ribosome display libraries. Phage display is described, for example, in Ladner et al., U.S. Pat. No. 5,223,409; Smith (1985) Science 228:1315-1317; and WO 92/18619. In some embodiments, recombinant monoclonal antibodies are isolated from phage display libraries expressing variable domains or CDRs of a desired species. Screening of phage libraries can be accomplished by various techniques known in the art.

Methods are known in the art for achieving high affinity binding with humanized antibodies. A non-limiting example of such a method is hypermutation of the variable region and selection of the cells expressing such high affinity antibodies (affinity maturation). In addition to the use of display libraries, the specified antigen (e.g. recombinant Claudin18.2 or an epitope thereof) can be used to immunize a non-human animal, e.g., a rodent. In certain embodiments, rodent antigen-binding fragments (e.g., mouse antigen-binding fragments) can be generated and isolated using methods known in the art and/or disclosed herein. In some embodiments, a mouse can be immunized with an antigen (e.g., recombinant Claudin18.2 or an epitope thereof).

In some embodiments, monoclonal antibodies are prepared using hybridoma methods known to one of skill in the art. For example, using a hybridoma method, a mouse, rat, rabbit, hamster, or other appropriate host animal, is immunized as described above. In some embodiments, lymphocytes are immunized in vitro. In some embodiments, the immunizing antigen is a human protein or a fragment thereof. In some embodiments, the immunizing antigen is a human protein or a fragment thereof.

Following immunization, lymphocytes are isolated and fused with a suitable myeloma cell line using, for example, polyethylene glycol. The hybridoma cells are selected using specialized media as known in the art and unfused lymphocytes and myeloma cells do not survive the selection process. Hybridomas that produce monoclonal antibodies directed to a chosen antigen can be identified by a variety of methods including, but not limited to, immunoprecipitation, immunoblotting, and in vitro binding assays (e.g., flow cytometry, FACS, ELISA, SPR (e.g., Biacore), and radioimmunoassay). Once hybridoma cells that produce antibodies of the desired specificity, affinity, and/or activity are identified, the clones may be subcloned by limiting dilution or other techniques. The hybridomas can be propagated either in in vitro culture using standard methods or in vivo as ascites tumors in an animal. The monoclonal antibodies can be purified from the culture medium or ascites fluid according to standard methods in the art including, but not limited to, affinity chromatography, ion-exchange chromatography, gel electrophoresis, and dialysis.

In some embodiments, monoclonal antibodies are made using recombinant DNA techniques as known to one skilled in the art. For example, the polynucleotides encoding an antibody are isolated from mature B-cells or hybridoma cells, such as by RT-PCR using oligonucleotide primers that specifically amplify the genes encoding the heavy and light chains of the antibody, and their sequence is determined using standard techniques. The isolated polynucleotides encoding the heavy and light chains are then cloned into suitable expression vectors which produce the monoclonal antibodies when transfected into host cells such as E. coli, simian COS cells, Chinese hamster ovary (CHO) cells, or myeloma cells that do not otherwise produce immunoglobulin proteins.

In some embodiments, recombinant monoclonal antibodies are isolated from phage display libraries expressing variable domains or CDRs of a desired species. Screening of phage libraries can be accomplished by various techniques known in the art.

In some embodiments, a monoclonal antibody is modified by using recombinant DNA technology to generate alternative antibodies. In some embodiments, the constant domains of the light chain and heavy chain of a mouse monoclonal antibody are replaced with the constant regions of a human antibody to generate a chimeric antibody. In some embodiments, the constant regions are truncated or removed to generate a desired antibody fragment of a monoclonal antibody. In some embodiments, site-directed or high-density mutagenesis of the variable region(s) is used to optimize specificity and/or affinity of a monoclonal antibody.

In some embodiments, a Claudin18.2-binding moiety is a humanized antibody. Various methods for generating humanized antibodies are known in the art. In some embodiments, a humanized antibody comprises one or more amino acid residues that have been introduced into its sequence from a source that is non-human. In some embodiments, humanization is performed by substituting one or more non-human CDR sequences for the corresponding CDR sequences of a human antibody. In some embodiments, the humanized antibodies are constructed by substituting all three CDRs of a non-human antibody (e.g., a heavy chain or light chain antibody) for the corresponding CDRs of a human antibody. In some embodiments, the humanized antibodies are constructed by substituting all six CDRs of a non-human antibody (e.g., a mouse antibody) for the corresponding CDRs of a human antibody.

The choice of which human heavy chain variable region and/or light chain variable region are used for generating humanized antibodies can be made based on a variety of factors and by a variety of methods known in the art. In some embodiments, a particular variable region framework derived from a consensus sequence of all human antibodies of a particular subgroup of light or heavy chains is selected as the variable region framework. In some embodiments, the variable region framework sequence is derived from the consensus sequences of the most abundant human subclasses. In some embodiments, human germline genes are used as the source of the variable region framework sequences.

In some embodiments, a Claudin18.2-binding moiety is a human antibody. Human antibodies can be prepared using various techniques known in the art. In some embodiments, human antibodies are generated from immortalized human B lymphocytes immunized in vitro. In some embodiments, human antibodies are generated from lymphocytes isolated from an immunized individual. In any case, cells that produce an antibody directed against a target antigen can be generated and isolated. In some embodiments, a human antibody is selected from a phage library, where that phage library expresses human antibodies. Alternatively, phage display technology may be used to produce human antibodies and antibody fragments in vitro, from immunoglobulin variable region gene repertoires from unimmunized donors. Techniques for the generation and use of antibody phage libraries are well-known in the art. Once antibodies are identified, affinity maturation strategies known in the art, including but not limited to, chain shuffling and site-directed mutagenesis, may be employed to generate higher affinity human antibodies. In some embodiments, human antibodies are produced in transgenic mice that contain human immunoglobulin loci. Upon immunization these mice are capable of producing the full repertoire of human antibodies in the absence of endogenous immunoglobulin production.

In some embodiments, a Claudin18.2-binding moiety is an antibody that binds Claudin18.2. In some embodiments, an anti-Claudin18.2 antibody binds human Claudin18.2. In some embodiments, an anti-Claudin18.2 antibody binds a Claudin18.2 epitope. In some embodiments, an anti-Claudin18.2 antibody binds the extracellular domain of Claudin18.2. In some embodiments, an anti-Claudin18.2 antibody binds the first extracellular loop of Claudin18.2. In some embodiments, an anti-Claudin18.2 antibody binds the second extracellular loop of Claudin18.2. In some embodiments, an anti-Claudin18.2 antibody binds Claudin18.2 with an affinity that is at least 20-fold greater than the antibody's affinity to Claudin 18.1. In some embodiments, an anti-Claudin18.2 antibody binds Claudin18.2 with an affinity that is at least 50-fold greater than the antibody's affinity to Claudin18.1. In some embodiments, an anti-Claudin18.2 antibody binds Claudin18.2 with an affinity that is at least 100-fold greater than the antibody's affinity to Claudin18.1. In some embodiments, an anti-Claudin18.2 antibody does not detectably bind Claudin18.1.

CDRs of an antibody are defined by those skilled in the art using a variety of methods/systems. These systems and/or definitions have been developed and refined over a number of years and include Kabat, Chothia, IMGT, AbM, and Contact. The Kabat definition is based on sequence variability and is commonly used. The Chothia definition is based on the location of the structural loop regions. The IMGT system is based on sequence variability and location within the structure of the variable domain. The AbM definition is a compromise between Kabat and Chothia. The Contact definition is based on analyses of the available antibody crystal structures. An Exemplary system is a combination of Kabat and Chothia. Software programs (e.g., abYsis) are available and known to those of skill in the art for analysis of antibody sequence and determination of CDRs.

The specific CDR sequences defined herein are generally based on a combination of Kabat and Chothia definitions (Exemplary system). However, it will be understood that reference to a heavy chain CDR or CDRs and/or a light chain CDR or CDRs of a specific antibody will encompass all CDR definitions as known to those of skill in the art.

Claudin18.2-binding moieties provided herein include anti-Claudin18.2 antibodies provided herein, and humanized versions thereof. In some embodiments, the anti-Claudin18.2 antibodies include 260G9E8, 252F1B10, 257B1G9, 265E6G2, 250F4G4, 262C7C10, 240F8G2, 232C5E3, 252E7C9, 257G7B9, 241H10A1, 273C10E5, 185F2G12, 194D3B2, 207F8G5, 222B6G5, 182D10F1, 234B9D4, 253E4F7, 198F10B8, 213B10A4, 370E2B12C3, 237D2A4, 203A6C9, 201F4H6, 429H6C5, 407D8G1, 419B5G9, 393C2C5, 412B6E4, 414A5F7, 418D2F9, 410H6H3; Others 59B6C4, 246B5F2 (IgM), 418G6A5, 417A6F11, 28C5B1, 35E8D2, 61H12G10, 69D5C1, 181C7B2, 196A12B10, 232D7C8, 233D5E5, 232F1E4, 231H4G11, 226A4B5, 235A10C9, 239H12G9, 248E6A7, 254A8D5, 259C6F4 and 280F3B6.

Based on the CDR sequence similarities, anti-Claudin18.2 antibodies provided herein can be divided to the five groups, as shown in Table 1 and 2.

In some embodiments, a Claudin18.2-binding moiety is an anti-Claudin18.2 antibody that comprises one, two, three, four, five, and/or six CDRs of any one of the antibodies described herein. In some embodiments, an anti-Claudin18.2 antibody comprises one, two, and/or three, VH CDRs, or the variable region from Table 1. In some embodiments, an anti-Claudin18.2 antibody comprises one, two, and/or three VL CDRs, or the variable region from Table 2. In some embodiments, an anti-Claudin18.2 antibody comprises one, two, and/or three VH CDRs or the variable region from Table 1 and one, two, and/or three VL CDRs or the variable region from Table 2.

The heavy chain variable region CDRs and the light chain variable region CDRs in Table 1 and 2 have been defined by the Kabat numbering system. However, as is well known in the art, CDR regions can also be determined by other systems such as Chothia, IMGT, AbM, or Contact numbering system/method, based on heavy chain/light chain variable region sequences.

TABLE 1

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| GROUP 1 | | | | |
| 260G9E8 | SHNMH (SEQ ID NO: 69) | YIYPGNGGTKYNQKFTG (SEQ ID NO: 89) | DYYGNSFAY (SEQ ID NO: 117) | SEQ ID NO: 1 |
| 252F1B10 | SHNMH (SEQ ID NO: 69) | YIYPGNGGTNYNQKFKG (SEQ ID NO: 90) | DYYGNSFAY (SEQ ID NO: 117) | SEQ ID NO: 3 |
| 257B1G9 | SHNMH (SEQ ID NO: 69) | YIYPGNGGTNYNQKFKG (SEQ ID NO: 90) | DYYGNSFAY (SEQ ID NO: 117) | SEQ ID NO: 5 |
| 265E6G2 | SYNMH (SEQ ID NO: 70) | YIYPGNGGTNYNQKFKG (SEQ ID NO: 90) | DYYGNSFAY (SEQ ID NO: 117) | SEQ ID NO: 7 |
| 250F4G4 | SHNMH (SEQ ID NO: 69) | YIYPGNGRTNYNQKFKG (SEQ ID NO: 91) | DYYGNSFAY (SEQ ID NO: 117) | SEQ ID NO: 9 |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| 262C7C10 | NYNIH (SEQ ID NO: 71) | YIYPGNGGNYYNQKFKG (SEQ ID NO: 92) | DYYGNSFAY (SEQ ID NO: 117) | SEQ ID NO: 11 |
| 240F8G2 | NYNIH (SEQ ID NO: 71) | YIYPGNGGNYYNQKFKG (SEQ ID NO: 92) | DYYGNSFAY (SEQ ID NO: 117) | SEQ ID NO: 281 |
| 232C5E3 | SHNIH (SEQ ID NO: 72) | YIYPGNGGTNYNQKFKA (SEQ ID NO: 93) | DYYGNSFAY (SEQ ID NO: 117) | SEQ ID NO: 13, 348-352 |
| 252E7C9 | SHNMH (SEQ ID NO: 69) | YIYPGNGGSYYNQKFKG (SEQ ID NO: 94) | DYYGNSFVY (SEQ ID NO: 118) | SEQ ID NO: 15 |
| 257G7B9 | SHNLH (SEQ ID NO: 73) | YIYPGNGNTNYNQKFKG (SEQ ID NO: 95) | DYYGNSFAY (SEQ ID NO: 117) | SEQ ID NO: 17 |
| 241H10A1 | SFGIN (SEQ ID NO: 74) | WIFPGDGNSKYNENFKG (SEQ ID NO: 96) | FYYGNSFAN (SEQ ID NO: 119) | SEQ ID NO: 19 |
| 273C10E5 | SFGIN (SEQ ID NO: 74) | WIFPGDGNSKYNENFKG (SEQ ID NO: 96) | FYYGNSFAN (SEQ ID NO: 119) | SEQ ID NO: 21 |
| 234A10F7 | SFGIN (SEQ ID NO: 74) | WIFPGDGNSKYNENFKG (SEQ ID NO: 96) | FYYGNSFAY (SEQ ID NO: 130) | SEQ ID NO: 495 |
| 240D6F5 | SHNMH (SEQ ID NO: 69) | YIYPGNGGTNYNQKFKG (SEQ ID NO: 90) | DYYGNSFAY (SEQ ID NO: 117) | SEQ ID NO: 497 |
| 242H12D6 | SHNMH (SEQ ID NO: 69) | YIYPGNGGTNYNQKFKG (SEQ ID NO: 90) | DYYGNSFAY (SEQ ID NO: 117) | SEQ ID NO: 499 |
| 243B4F2 | SHNLH (SEQ ID NO: 73) | YIYPGNGNTNYNQKFKG (SEQ ID NO: 95) | DYYGNSFAY (SEQ ID NO: 117) | SEQ ID NO: 501 |
| 243B4F7 | SHNLH (SEQ ID NO: 73) | YIYPGNGNTNYNQKFKG (SEQ ID NO: 95) | DYYGNSFAY (SEQ ID NO: 117) | SEQ ID NO: 503 |
| 243F6D2 | SHNMH (SEQ ID NO: 69) | YIYPGNGGTYYNQKFKG (SEQ ID NO: 202) | DYYGNSFVY (SEQ ID NO: 118) | SEQ ID NO: 505 |
| 250F4G1 | SHNMH (SEQ ID NO: 69) | YIYPGNGRTNYNQKFKG (SEQ ID NO: 91) | DYYGNSFAY (SEQ ID NO: 117) | SEQ ID NO: 507 |
| 257F1E11 | SHNIH (SEQ ID NO: 72) | YIYPGNGGTNYNQKFKG (SEQ ID NO: 90) | DYYGNSFAY (SEQ ID NO: 117) | SEQ ID NO: 509 |
| 257G7F7 | SHNLH (SEQ ID NO: 73) | YIYPGNGNTNYNQKFKG (SEQ ID NO: 95) | DYYGNSFAY (SEQ ID NO: 117) | SEQ ID NO: 511 |
| 260F8A6 | SHNMH (SEQ ID NO: 69) | YIYPGNGNTYYNQKFKG (SEQ ID NO: 390) | DYYGNSFVY (SEQ ID NO: 118) | SEQ ID NO: 513 |
| 268D7H9 | NYNIH (SEQ ID NO: 71) | YIYPGNGGNYYNQKFKG (SEQ ID NO: 92) | DYYGNSFAY (SEQ ID NO: 117) | SEQ ID NO: 515 |
| 271B1B6 | NYNIH (SEQ ID NO: 71) | YIYPGNGGNYYNQKFKG (SEQ ID NO: 92) | DYYGNSFAY (SEQ ID NO: 117) | SEQ ID NO: 517 |
| 275H9A2 | SHNMH (SEQ ID NO: 69) | YIYPGNGGSYYNQKFKG (SEQ ID NO: 94) | DYYGNSFVY (SEQ ID NO: 118) | SEQ ID NO: 519 |
| Consensus | $X_1X_2X_3X_4X_5$<br>$X_1$ = S, N<br>$X_2$ = H, Y, F<br>$X_3$ = N, G<br>$X_4$ = M, I, L<br>$X_5$ = H, N<br>(SEQ ID NO: 174) | $X_6IX_7PGX_8GX_9X_{10}X_{11}YNX_{12}X_{13}FX_{14}X_{15}$<br>$X_6$ = Y, W<br>$X_7$ = Y, F<br>$X_8$ = N, D<br>$X_9$ = G, R, N<br>$X_{10}$ = T, N, S<br>$X_{11}$ = K, N, Y<br>$X_{12}$ = Q, E<br>$X_{13}$ = K, N<br>$X_{14}$ = T, K<br>$X_{15}$ = G, A<br>(SEQ ID NO: 175) | $X_{16}YYGNSFX_{17}X_{18}$<br>$X_{16}$ = D, F<br>$X_{17}$ = A, V<br>$X_{18}$ = Y, N<br>(SEQ ID NO: 176) | |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| Model | SHNMH (SEQ ID NO: 69) | YIYPGNGGTNYNQKFKG (SEQ ID NO: 90) | DYYGNSFAY (SEQ ID NO: 117) | |
| GROUP 2 | | | | |
| 185F2G12 | SYNMH (SEQ ID NO: 70) | YIYPGNGGTNYSQKFKG (SEQ ID NO: 97) | GRGFAY (SEQ ID NO: 120) | SEQ ID NO: 23 |
| 194D3B2 | SYNMH (SEQ ID NO: 70) | YIYPGNGGTNYNQKFRD (SEQ ID NO: 98) | GRGFAY (SEQ ID NO: 120) | SEQ ID NO: 25 |
| 207F8G5 | SYNIH (SEQ ID NO: 75) | YISPGNGGSNYNLKFKD (SEQ ID NO: 99) | GRGFAY (SEQ ID NO: 120) | SEQ ID NO: 27, 337-345 |
| 222B6G5 | SYNIH (SEQ ID NO: 75) | YISPGNGGTYYNLKFKD (SEQ ID NO: 100) | GRGFAY (SEQ ID NO: 120) | SEQ ID NO: 29 |
| 182D10F1 | SYNMH (SEQ ID NO: 70) | YIYPGNGGTNYNQKFKG (SEQ ID NO: 90) | GRGFTY (SEQ ID NO: 121) | SEQ ID NO: 31 |
| 234B9D4 | SYYIH (SEQ ID NO: 76) | YIDPFNGGTRYNQKFEG (SEQ ID NO: 101) | LRFFTY (SEQ ID NO: 122) | SEQ ID NO: 33 |
| 253E4F7 | SYYIH (SEQ ID NO: 76) | YIDPFNGGTRYNQKFEG (SEQ ID NO: 101) | LRFLAY (SEQ ID NO: 123) | SEQ ID NO: 35 |
| 198F10B8 | SYNMH (SEQ ID NO: 70) | YIYPGNGGTNYNQKFKD (SEQ ID NO: 201) | GRGFAY (SEQ ID NO: 120) | SEQ ID NO: 263 |
| 213B10A4 | SYNMH (SEQ ID NO: 70) | YIYPGNGGTYYNQKFKG (SEQ ID NO: 202) | GRGFAY (SEQ ID NO: 120) | SEQ ID NO: 265 |
| Consensus | SYX$_{27}$X$_{28}$H<br>X$_{27}$ = N, Y<br>X$_{28}$ = M, I<br>(SEQ ID NO: 177) | YIX$_{29}$PX$_{30}$NGGX$_{31}$X$_{32}$YX$_{33}$X$_{34}$KFX$_{35}$X$_{36}$<br>X$_{29}$ = Y, S, D<br>X$_{30}$ = G, F<br>X$_{31}$ = T, S<br>X$_{32}$ = N, Y, R<br>X$_{33}$ = S, N<br>X$_{34}$ = Q, L<br>X$_{35}$ = K, R, E<br>X$_{36}$ = G, D<br>(SEQ ID NO: 178) | X$_{37}$RX$_{38}$X$_{39}$X$_{40}$Y<br>X$_{37}$ = G, L<br>X$_{38}$ = G, F<br>X$_{39}$ = F, L<br>X$_{40}$ = A, T<br>(SEQ ID NO: 179) | |
| Model | SYNIH (SEQ ID NO: 75) | YIYPGNGGTNYNQKFKG (SEQ ID NO: 90) | GRGFAY (SEQ ID NO: 120) | |
| GROUP 3 | | | | |
| 370E2B12C3 | TYGVH (SEQ ID NO: 77) | VIWAGGSTNYNSALMS (SEQ ID NO: 102) | AAYYGNGLDY (SEQ ID NO: 124) | SEQ ID NO: 37, 372-374 |
| 237D2A4 | SYGVS (SEQ ID NO: 78) | VIWGDGSTNYHSTLIS (SEQ ID NO: 103) | AGRGNALDY (SEQ ID NO: 125) | SEQ ID NO: 39, 355-362 |
| 203A6C9 | RYGVH (SEQ ID NO: 79) | VIWSGGNTDYNAAFIS (SEQ ID NO: 104) | AAYFGNSFDY (SEQ ID NO: 126) | SEQ ID NO: 41 |
| 201F4H6 | SYGVS (SEQ ID NO: 78) | VIWAGGNTNYNSALMS (SEQ ID NO: 105) | VYYGNAMDY (SEQ ID NO: 127) | SEQ ID NO: 43 |
| 200A4H8 | RYGVH (SEQ ID NO: 79) | VIWSGGNTDYNAAFIS (SEQ ID NO: 104) | AAYFGNSFDY (SEQ ID NO: 126) | SEQ ID NO: 521 |
| 203 A6D5 | RYGVH (SEQ ID NO: 79) | VIWSGGNTDYNAAFIS (SEQ ID NO: 104) | AAYFGNSFDY (SEQ ID NO: 126) | SEQ ID NO: 523 |
| 248G8E8 | TYGVS (SEQ ID NO: 209) | VIWGDGSTNYHSTLIS (SEQ ID NO: 103) | AGRGNALDY (SEQ ID NO: 125) | SEQ ID NO: 525 |
| Consensus | X$_{47}$YGVX$_{48}$<br>X$_{47}$ = T, S, R<br>X$_{48}$ = H, S<br>(SEQ ID NO: 180) | VIWX$_{49}$X$_{50}$GX$_{51}$TX$_{52}$YX$_{53}$X$_{54}$X$_{55}$X$_{56}$X$_{57}$S<br>X$_{49}$ = A, G, S<br>X$_{50}$ = G, D<br>X$_{51}$ = S, N | X$_{58}$X$_{59}$X$_{60}$X$_{61}$GNX$_{62}$X$_{63}$DY<br>(SEQ ID NO: 182)<br>X$_{58}$ = A or null<br>X$_{59}$ = A, G, V<br>X$_{60}$ = Y, R | |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| | | $X_{52}$ = N, D<br>$X_{53}$ = N, H<br>$X_{54}$ = S, A<br>$X_{55}$ = A, T<br>$X_{56}$ = L, F<br>$X_{57}$ = M, I<br>(SEQ ID NO: 181) | $X_{61}$ = Y, F or null<br>$X_{62}$ = A, G, S<br>$X_{63}$ = L, F, M | |
| Model | SYGVS<br>(SEQ ID NO: 78) | VIWAGGSTNYHSALMS<br>(SEQ ID NO: 197) | AAYYGNALDY<br>(SEQ ID NO: 198) | |

GROUP 4

| Antibody | VH CDR1 | VH CDR2 | VH CDR3 | VH |
|---|---|---|---|---|
| 429H6C5 | SFGMH (SEQ ID NO: 80) | YISSGSSTIYYAHTVKG (SEQ ID NO: 106) | FYYGNSFVN (SEQ ID NO: 128) | SEQ ID NO: 47 |
| 407D8G1 | GFGMH (SEQ ID NO: 81) | YISSGSRPIYYADTVQG (SEQ ID NO: 107) | FYYGNSFDH (SEQ ID NO: 129) | SEQ ID NO: 49 |
| 419B5G9 | TFGMH (SEQ ID NO: 82) | YISGGSTTIFYADTVKG (SEQ ID NO: 108) | FYYGNSFAY (SEQ ID NO: 130) | SEQ ID NO: 51 |
| 393C2C5 | SFGMH (SEQ ID NO: 80) | YISSGSSPIYYADTVKG (SEQ ID NO: 109) | FYYGNSFAY (SEQ ID NO: 130) | SEQ ID NO: 53 |
| 412B6E4 | SFGVH (SEQ ID NO: 83) | YISSGSSTIYYAHSVKG (SEQ ID NO: 110) | FYYGNSFAY (SEQ ID NO: 130) | SEQ ID NO: 55, 383-385 |
| 414A5F7 | SFGMH (SEQ ID NO: 80) | YISSGSSPIYYADTVKG (SEQ ID NO: 109) | IYYGNSFAY (SEQ ID NO: 131) | SEQ ID NO: 57 |
| 418D2F9 | SFGMH (SEQ ID NO: 80) | YINTGSSTIYYADTVKG (SEQ ID NO: 111) | IYYGNSFVY (SEQ ID NO: 132) | SEQ ID NO: 59 |
| 410H6H3 | SSGMH (SEQ ID NO: 84) | YISSGSNTIYYADTLKG (SEQ ID NO: 112) | IYYGNSFVY (SEQ ID NO: 132) | SEQ ID NO: 61, 378-380 |
| 391F1G2 | SFGMH (SEQ ID NO: 80) | YISSGSSPIYYADTVKG (SEQ ID NO: 109) | IYYGNSFAY (SEQ ID NO: 131) | SEQ ID NO: 527 |
| 406F11G8 | SFGMH (SEQ ID NO: 80) | YISSGSSPIYYADTVKG (SEQ ID NO: 109) | IYYGNSFAY (SEQ ID NO: 131) | SEQ ID NO: 529 |
| 410A9A9 | SFGMH (SEQ ID NO: 80) | YISSGSSPIYYADTVKG (SEQ ID NO: 109) | FYYGNSFAY (SEQ ID NO: 130) | SEQ ID NO: 531 |
| 410D9G2 | GFGMH (SEQ ID NO: 81) | YISSGSRPIYYADTVQG (SEQ ID NO: 107) | FYYGNSFDH (SEQ ID NO: 129) | SEQ ID NO: 533 |
| 416F12F3 | SFGMH (SEQ ID NO: 80) | YISSGSSTIYYAHSVKG (SEQ ID NO: 110) | FYYGNSFAY (SEQ ID NO: 130) | SEQ ID NO: 535 |
| 420H3H9 | SFGMH (SEQ ID NO: 80) | YISSGSSTIYYAHSVKG (SEQ ID NO: 110) | FYYGNSFAY (SEQ ID NO: 130) | SEQ ID NO: 537 |
| 411G12G1 | GFGMH (SEQ ID NO: 81) | YISSGSRPIYYADTVKG (SEQ ID NO: 391) | FYYGNSFDH (SEQ ID NO: 129) | SEQ ID NO: 539 |
| 429G4E9 | SFGMH (SEQ ID NO: 80) | YISSGSSPIYYADTVKG (SEQ ID NO: 109) | FYYGNSFAY (SEQ ID NO: 130) | SEQ ID NO: 541 |
| 391H11H3 | GFGMH (SEQ ID NO: 81) | YISSGSRPIYYADTVQG (SEQ ID NO: 107) | FYYGNSFDH (SEQ ID NO: 129) | SEQ ID NO: 543 |
| 395B3C11 | GFGMH (SEQ ID NO: 81) | YISSGSRPIYYADTVQG (SEQ ID NO: 107) | FYYGNSFDH (SEQ ID NO: 129) | SEQ ID NO: 545 |
| 406E1H7 | GFGMH (SEQ ID NO: 81) | YISSGSRPIYYADTVQG (SEQ ID NO: 107) | FYYGNSFDH (SEQ ID NO: 129) | SEQ ID NO: 547 |
| 414H6G2 | GFGMH (SEQ ID NO: 81) | YISSGSRPIYYADTVQG (SEQ ID NO: 107) | FYYGNSFDH (SEQ ID NO: 129) | SEQ ID NO: 549 |
| 420G10G3 | GFGMH (SEQ ID NO: 81) | YISSGSRPIYYADTVQG (SEQ ID NO: 107) | FYYGNSFDH (SEQ ID NO: 129) | SEQ ID NO: 551 |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| 422E8F9 | GFGMH (SEQ ID NO: 81) | YISSGSRPIYYADTVQG (SEQ ID NO: 107) | FYYGNSFDH (SEQ ID NO: 129) | SEQ ID NO: 553 |
| 422F4B6 | SFGMH (SEQ ID NO: 80) | YISSGSSPIYYADTVKG (SEQ ID NO: 109) | IYYGNSFAY (SEQ ID NO: 131) | SEQ ID NO: 555 |
| 425B3D5 | GFGMH (SEQ ID NO: 81) | YISSGSRPIYYADTVQG (SEQ ID NO: 107) | FYYGNSFDH (SEQ ID NO: 129) | SEQ ID NO: 557 |
| 425C6D3 | GFGMH (SEQ ID NO: 81) | YISSGSRPIYYADTVQG (SEQ ID NO: 107) | FYYGNSFDH (SEQ ID NO: 129) | SEQ ID NO: 559 |
| 426H6E11 | GFGMH (SEQ ID NO: 81) | YISSGSRPIYYADTVQG (SEQ ID NO: 107) | FYYGNSFDH (SEQ ID NO: 129) | SEQ ID NO: 561 |
| Consensus | $X_{72}X_{73}$GMH $X_{72}$ = S, G, T $X_{73}$ = F, S (SEQ ID NO: 183) | YI$X_{74}X_{75}$GS$X_{76}X_{77}$I$X_{78}$YA$X_{79}X_{80}X_{81}X_{82}$G $X_{74}$ = S, N $X_{75}$ = S, G, T $X_{76}$ = S, R, T, N $X_{77}$ = T, P $X_{78}$ = Y, F $X_{79}$ = D, H $X_{80}$ = T, S $X_{81}$ = V, L $X_{82}$ = K, Q (SEQ ID NO: 184) | $X_{83}$YYGNSF$X_{84}X_{85}$ $X_{83}$ = F, I $X_{84}$ = V, D, A $X_{85}$ = Y, N, H (SEQ ID NO: 185) | |
| Model | SGFTFSSFGMH (SEQ ID NO: 80) | YISSGSSTIYYADTVKG (SEQ ID NO: 199) | FYYGNSFAY (SEQ ID NO: 130) | |
| OTHERS | | | | |
| 59B6C4 | SSWMH (SEQ ID NO: 85) | ANYPGKSDTTYTQKFKG (SEQ ID NO: 113) | GAYYGNAMDY (SEQ ID NO: 133) | SEQ ID NO: 67 |
| 246B5F2 (IgM) | NYAMS (SEQ ID NO: 86) | TISSGRSSTYYPDSVKG (SEQ ID NO: 114) | LGRGNAMEY (SEQ ID NO: 134) | SEQ ID NO: 45, 365-369 |
| 418G6A5 | SFGMH (SEQ ID NO: 87) | YISSGSSPMYYADTVKG (SEQ ID NO: 115) | IYYGNSFAY (SEQ ID NO: 131) | SEQ ID NO: 63 |
| 417A6F11 | SGYSFTGYTMN (SEQ ID NO: 88) | LINPYNGGTSYNQKFKG (SEQ ID NO: 116) | GDY (SEQ ID NO: 135) | SEQ ID NO: 65 |
| 28C5B1 | SYWIE (SEQ ID NO: 203) | EILPGSGSTNYNEKFKG (SEQ ID NO: 211) | YGGLRRYFDY (SEQ ID NO: 225) | SEQ ID NO: 251 |
| 35E8D2 | TAGMQ (SEQ ID NO: 204) | WINTHSRVPNFAEDFKG (SEQ ID NO: 212) | LGKGNTMDF (SEQ ID NO: 226) | SEQ ID NO: 253 |
| 61H12G10 | DYGVS (SEQ ID NO: 205) | VIWGGGSTYYNSALKS (SEQ ID NO: 213) | HHYGNACDY (SEQ ID NO: 227) | SEQ ID NO: 255 |
| 69D5C1 | DYGMA (SEQ ID NO: 206) | FISNLAYSIYYADTVTG (SEQ ID NO: 214) | IYYGNSFAY (SEQ ID NO: 131) | SEQ ID NO: 257 |
| 181C7B2 | YYGVH (SEQ ID NO: 207) | VIWRGGNTDYNAAFIS (SEQ ID NO: 215) | AAYYGNCFDY (SEQ ID NO: 228) | SEQ ID NO: 259 |
| 196A12B10 | DYSMH (SEQ ID NO: 208) | WINSETGEATYADDFRG (SEQ ID NO: 216) | FYYGNSFAS (SEQ ID NO: 229) | SEQ ID NO: 261 |
| 232D7C8 | SHNMH (SEQ ID NO: 69) | YIYPGNGGTNYNQKFKG (SEQ ID NO: 90) | DYFGNSFAY (SEQ ID NO: 230) | SEQ ID NO: 267 |
| 233D5E5 | SHNMH (SEQ ID NO: 69) | YIYPGNGDTNYNQKFKG (SEQ ID NO: 217) | DYYGNSFAY SEQ ID NO: 117 | SEQ ID NO: 269 |
| 232F1E4 | TYGVS (SEQ ID NO: 209) | VIWGDGSTHYHSALIS (SEQ ID NO: 218) | PGRGNAMDY (SEQ ID NO: 231) | SEQ ID NO: 271 |
| 231H4G11 | SHNIH (SEQ ID NO: 72) | YISPGNGYTNYNQKFRG (SEQ ID NO: 219) | DYYGNSFAY (SEQ ID NO: 117) | SEQ ID NO: 273 |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| 226A4B5 | SYNIH (SEQ ID NO: 75) | YIYPGSGGSNYNQKFMG (SEQ ID NO: 220) | GRGFAY (SEQ ID NO: 120) | SEQ ID NO: 275 |
| 235A10C9 | SHNMH (SEQ ID NO: 69) | YIYPGNSGTKYNQKFTG (SEQ ID NO: 221) | DYYGNSFAY (SEQ ID NO: 117) | SEQ ID NO: 277 |
| 239H12G9 | SHNIH (SEQ ID NO: 72) | YIYPGNGAPNYNQKFRG (SEQ ID NO: 222) | DYYGNSFVY (SEQ ID NO: 118) | SEQ ID NO: 279 |
| 248E6A7 | SHNMH (SEQ ID NO: 69) | YIYPGNGNTYYNQKFKV (SEQ ID NO: 223) | DYYGNSFVY (SEQ ID NO: 118) | SEQ ID NO: 283 |
| 254A8D5 | SYTVS (SEQ ID NO: 210) | TSIVGSTYTYFPDSVKG (SEQ ID NO: 224) | LGRGNAMDY (SEQ ID NO: 232) | SEQ ID NO: 285 |
| 259C6F4 | SHNIH (SEQ ID NO: 72) | YIYPGNGDTNYNQKFKG (SEQ ID NO: 217) | DYYGNSFVY (SEQ ID NO: 118) | SEQ ID NO: 287 |
| 280F3B6 | SHNMH (SEQ ID NO: 69) | YIYPGNGGTNYNQKFKG (SEQ ID NO: 90) | DYYGNSFAY (SEQ ID NO: 117) | SEQ ID NO: 289 |
| 59B6C9E8 | SSWMH (SEQ ID NO: 85) | ANYPGKSDTTYTQKFKG (SEQ ID NO: 113) | GAYYGNAMDY (SEQ ID NO: 133) | SEQ ID NO: 563 |
| 186F7E10 | SYAMS (SEQ ID NO: 392) | TITSGVSHTYYFPDSVKG (SEQ ID NO: 393) | LYYGNSLDY (SEQ ID NO: 394) | SEQ ID NO: 565 |
| 186G12H3 | SYAMS (SEQ ID NO: 392) | TISSGGSYTYYFPDSVKG (SEQ ID NO: 395) | LYYGNALDY (SEQ ID NO: 396) | SEQ ID NO: 567 |
| 194A2F7 | DYLIH (SEQ ID NO: 397) | WINTETGEPTYADDFKG (SEQ ID NO: 398) | IYYGNSFDY (SEQ ID NO: 399) | SEQ ID NO: 569 |
| 217D9G2 | SYNIH (SEQ ID NO: 75) | YISPGNGGSNYNLNFKD (SEQ ID NO: 400) | GRGFAY (SEQ ID NO: 120) | SEQ ID NO: 571 |
| 219F9B8 | SYNMH (SEQ ID NO: 70) | YIYPGNGHTNYNQKFKG (SEQ ID NO: 401) | GRGFAY (SEQ ID NO: 120) | SEQ ID NO: 573 |
| 231C11E9 | NYVMC (SEQ ID NO: 402) | TISSGNFYTYYPDSVKG (SEQ ID NO: 403) | LGRGNALDN (SEQ ID NO: 404) | SEQ ID NO: 575 |
| 234C9G5 | SHNMH (SEQ ID NO: 69) | YISPGNGYTNYNQKFRG (SEQ ID NO: 219) | DYYGNSFAY (SEQ ID NO: 117) | SEQ ID NO: 577 |
| 234E1F12 | SHNMH (SEQ ID NO: 69) | YIYPGNGDTNYNQKFKG (SEQ ID NO: 217) | DYYGNSFAY (SEQ ID NO: 117) | SEQ ID NO: 579 |
| 240A8E7 | NYNIH (SEQ ID NO: 71) | YIYPGNGDNYYNQKFKG (SEQ ID NO: 405) | DYYGNSFAY (SEQ ID NO: 117) | SEQ ID NO: 581 |
| 242F5H2 | SYTVS (SEQ ID NO: 210) | TSIVGSTYTYFPDSVKG (SEQ ID NO: 224) | LGRGNAMDY (SEQ ID NO: 232) | SEQ ID NO: 583 |
| 244A1B8 | SHNIH (SEQ ID NO: 72) | YIYPGNGAPNYNQKFRG (SEQ ID NO: 222) | DYYGNSFVY (SEQ ID NO: 118) | SEQ ID NO: 585 |
| 252C10F6 | NYGVH (SEQ ID NO: 406) | VIWSGGNTDYNTVFKA (SEQ ID NO: 407) | NLYGNYDYAMDY (SEQ ID NO: 408) | SEQ ID NO: 587 |
| 256C3D3 | SHNMH (SEQ ID NO: 69) | YISPGNGYTNYNQKFRG (SEQ ID NO: 219) | DYYGNSFAY (SEQ ID NO: 117) | SEQ ID NO: 589 |
| 258D11C4 | SHNMH (SEQ ID NO: 69) | YIYPGNGGTNYNQKFKG (SEQ ID NO: 90) | DYYGNSFAY (SEQ ID NO: 117) | SEQ ID NO: 591 |
| 259B4D4 | SYMH (SEQ ID NO: 409) | YIDPFNGNTRYNQKFKD (SEQ ID NO: 410) | LRFFAY (SEQ ID NO: 411) | SEQ ID NO: 593 |
| 259C6F7 | SHNIH (SEQ ID NO: 72) | YIYPGNGDTNYNQKFKG (SEQ ID NO: 217) | DYYGNSFVY (SEQ ID NO: 118) | SEQ ID NO: 595 |

TABLE 1-continued

Amino acid sequence (or sequence ID number) of heavy
chain variable region (VH) or VH CDRs of Claudin18.2 antibodies

| Antibody | VH CDR1 | VH CDR2 | VH CDR3 | VH |
|---|---|---|---|---|
| 262H9H6 | SHNMH (SEQ ID NO: 69) | YISPGNGYTNYNQKFRG (SEQ ID NO: 219) | DYYGNSFTY (SEQ ID NO: 416) | SEQ ID NO: 597 |
| 263E9F3 | SYYIH (SEQ ID NO: 76) | YIDPFSGGTRYNQKFEG (SEQ ID NO: 412) | LRFFAY (SEQ ID NO: 411) | SEQ ID NO: 599 |
| 266B11F7 | TYGVT (SEQ ID NO: 413) | VIWGDGSTNYHSALTS (SEQ ID NO: 414) | PGRGNALDY (SEQ ID NO: 415) | SEQ ID NO: 601 |
| 267B2C5 | TYGVS (SEQ ID NO: 209) | VIWGDGSTHYHSALIS (SEQ ID NO: 218) | PGRGNAMDY (SEQ ID NO: 231) | SEQ ID NO: 603 |
| 267H5F12 | SHNMH (SEQ ID NO: 69) | YISPGNGYTNYNQKFRG (SEQ ID NO: 219) | DYYGNSFTY (SEQ ID NO: 416) | SEQ ID NO: 605 |
| 273F3D4 | TYGVS (SEQ ID NO: 209) | VIWGDGSTHYHSALIS (SEQ ID NO: 218) | PGRGNAMDY (SEQ ID NO: 231) | SEQ ID NO: 607 |
| 275B2G2 | DYTMS (SEQ ID NO: 417) | TSIIGGTYTYYPDSVKG (SEQ ID NO: 418) | LGRGNAMDY (SEQ ID NO: 232) | SEQ ID NO: 609 |
| 277F1F8 | SHNMH (SEQ ID NO: 69) | YINPGNGGNNYNQKFKG (SEQ ID NO: 419) | DYYGNSFAF (SEQ ID NO: 420) | SEQ ID NO: 611 |
| 286C7F11 | DYGVS (SEQ ID NO: 205) | VIWNRGNTYYNSALKS (SEQ ID NO: 421) | HDFLRFLDY (SEQ ID NO: 422) | SEQ ID NO: 613 |
| 292D9C7 | DYGVS (SEQ ID NO: 205) | VIWGGGNAYYNSALKS (SEQ ID NO: 423) | NGLLRYLDY (SEQ ID NO: 424) | SEQ ID NO: 615 |
| 392A11C8 | GFGMH (SEQ ID NO: 81) | YISSGSRPIYYADTVKG (SEQ ID NO: 391) | FYYGNSFDH (SEQ ID NO: 129) | SEQ ID NO: 617 |
| 392C2F10 | GYTMN (SEQ ID NO: 88) | LINPFNGGTTYNQKFKG (SEQ ID NO: 425) | GDY (SEQ ID NO: 135) | SEQ ID NO: 619 |
| 394C2G5 | GFGMH (SEQ ID NO: 81) | YVSSGSRPIYYADTVKG (SEQ ID NO: 426) | FYYGNSFDH (SEQ ID NO: 129) | SEQ ID NO: 621 |
| 405G8F11 | SFGMH (SEQ ID NO: 80) | YISSGSSPIYYADTVKG (SEQ ID NO: 109) | FYYGNSFAY (SEQ ID NO: 130) | SEQ ID NO: 623 |
| 406G3C4 | SYYIY (SEQ ID NO: 427) | YIDPFNGNTNYNQKFKG (SEQ ID NO: 428) | VNGYGRGAMDY (SEQ ID NO: 429) | SEQ ID NO: 625 |
| 407A8G10 | GFGMH (SEQ ID NO: 81) | YISSGSRPIYYADTVKG (SEQ ID NO: 391) | FYYGNSFDH (SEQ ID NO: 129) | SEQ ID NO: 627 |
| 407E11H8 | DFGMH (SEQ ID NO: 430) | YISSGSRPIYYADTVKG (SEQ ID NO: 391) | FYFGNSFDH (SEQ ID NO: 431) | SEQ ID NO: 629 |
| 407H12E6 | SFGMH (SEQ ID NO: 80) | YISSGSSPIYYADTVKG (SEQ ID NO: 109) | FYYGNSFDH (SEQ ID NO: 129) | SEQ ID NO: 631 |
| 409D1A7 | GFGMH (SEQ ID NO: 81) | YISSGSRPIYYADTVKG (SEQ ID NO: 391) | FYYGNSFDH (SEQ ID NO: 129) | SEQ ID NO: 633 |
| 409G10G6 | GFGMH (SEQ ID NO: 81) | YISSDSRPIYYADTVKG (SEQ ID NO: 432) | FYYGNSFDH (SEQ ID NO: 129) | SEQ ID NO: 635 |
| 411A6E3 | DFGMH (SEQ ID NO: 430) | YISSGSRPIYYADTVKG (SEQ ID NO: 391) | FYFGNSFDH (SEQ ID NO: 431) | SEQ ID NO: 637 |
| 411B4G4 | GFGLH (SEQ ID NO: 433) | YISSGSRPIYYADTVKG (SEQ ID NO: 391) | FYYGNSFDH (SEQ ID NO: 129) | SEQ ID NO: 639 |
| 411G3E10 | GFGMH (SEQ ID NO: 81) | YISSGSRPIYYADTVKG (SEQ ID NO: 391) | FYYGNSFDH (SEQ ID NO: 129) | SEQ ID NO: 641 |
| 413B1C9 | SFGMH (SEQ ID NO: 80) | YISSGSSPIYYADTVKG (SEQ ID NO: 109) | FYYGNSFDH (SEQ ID NO: 129) | SEQ ID NO: 643 |
| 413C12F8 | GFGVH (SEQ ID NO: 434) | YIGSGSRPIYYADTVKG (SEQ ID NO: 435) | FYYGNSFDH (SEQ ID NO: 129) | SEQ ID NO: 645 |

TABLE 1-continued

Amino acid sequence (or sequence ID number) of heavy chain variable region (VH) or VH CDRs of Claudin18.2 antibodies

| Antibody | VH CDR1 | VH CDR2 | VH CDR3 | VH |
|---|---|---|---|---|
| 413H4G12 | GYTMN (SEQ ID NO: 88) | LINPFNGGTTYNQKFKG (SEQ ID NO: 425) | GDY (SEQ ID NO: 135) | SEQ ID NO: 647 |
| 418B11D3 | SYYMY (SEQ ID NO: 436) | YIDPFNGNTNYNQKFKG (SEQ ID NO: 428) | VNGYGRGAMDY (SEQ ID NO: 429) | SEQ ID NO: 649 |
| 418B8B10 | SFGMH (SEQ ID NO: 80) | YISSGSSPIYYTDTVKG (SEQ ID NO: 437) | FYYGNSFDH (SEQ ID NO: 129) | SEQ ID NO: 651 |
| 419A10D4 | GFGMH (SEQ ID NO: 81) | YISSGSRPIYYADTVKG (SEQ ID NO: 391) | FYYGNSFDH (SEQ ID NO: 129) | SEQ ID NO: 653 |
| 419A5F3 | GFGMH (SEQ ID NO: 81) | YISSDSRPIYYADTVKG (SEQ ID NO: 432) | FYYGNSFDH (SEQ ID NO: 129) | SEQ ID NO: 655 |
| 420D5H5 | GFGMH (SEQ ID NO: 81) | YISSGSRPIYYVDTVEG (SEQ ID NO: 438) | FYYGNSFDH (SEQ ID NO: 129) | SEQ ID NO: 657 |
| 420F12G8 | GFGMH (SEQ ID NO: 81) | YISSGSRPIYYADTVKG (SEQ ID NO: 391) | FYYGNSFDH (SEQ ID NO: 129) | SEQ ID NO: 659 |
| 420H7E6 | SFGMH (SEQ ID NO: 80) | FISGGGSPIFYADSVKG (SEQ ID NO: 439) | FYFGNSFAY (SEQ ID NO: 441) | SEQ ID NO: 661 |
| 421H4G3 | GFGLH (SEQ ID NO: 433) | YISSGSRPIYYADTVKG (SEQ ID NO: 391) | FYFGNSFDH (SEQ ID NO: 431) | SEQ ID NO: 663 |
| 423B2B5 | SFGMH (SEQ ID NO: 80) | YISSGSSPIYYSDTVKG (SEQ ID NO: 442) | IYYGNSFDH (SEQ ID NO: 443) | SEQ ID NO: 665 |
| 423C10E1 | SFGMH (SEQ ID NO: 80) | FISGGGSPIFYADSVKG (SEQ ID NO: 440) | FYFGNSFAY (SEQ ID NO: 441) | SEQ ID NO: 667 |
| 424G9G3 | NFWMH (SEQ ID NO: 444) | MIDTSNGETRLNQIFKD (SEQ ID NO: 445) | YGNFAD (SEQ ID NO: 446) | SEQ ID NO: 669 |
| 426D9F6 | GFGMH (SEQ ID NO: 81) | YISSGSRPIYYADTVKG (SEQ ID NO: 391) | FYYGNSFDH (SEQ ID NO: 129) | SEQ ID NO: 671 |
| 427C7H2 | SYWMH (SEQ ID NO: 447) | NIYPGSGSTNYDEKFKS (SEQ ID NO: 448) | RITTATRDYFDY (SEQ ID NO: 449) | SEQ ID NO: 673 |
| 430A11H9 | SYTMS (SEQ ID NO: 450) | TISSGGSYTYYPDSVKG (SEQ ID NO: 451) | DPGYFAY (SEQ ID NO: 452) | SEQ ID NO: 675 |
| 430B3F1 | GFGMH (SEQ ID NO: 81) | YISSGGRPIYYADTVQG (SEQ ID NO: 453) | FYYGNSFDH (SEQ ID NO: 129) | SEQ ID NO: 677 |
| 279E8B8 | SHNMH (SEQ ID NO: 69) | YIYPGNGGTKYNQKFTG (SEQ ID NO: 89) | DYFGNSFVY (SEQ ID NO: 454) | SEQ ID NO: 679 |

TABLE 2

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| GROUP 1 | | | | |
| 260G9E8 | KSSQSLLNSGNQKNYLT (SEQ ID NO: 136) | WASTRES (SEQ ID NO: 143) | QNDYMFPFT (SEQ ID NO: 150) | SEQ ID NO: 2 |
| 252F1B10 | KSSQSLFNSGNQKNYLT (SEQ ID NO: 137) | WASTRES (SEQ ID NO: 143) | QNDYRPFT (SEQ ID NO: 151) | SEQ ID NO: 4 |
| 257B1G9 | KSSQSLFNSGNQKNYLT (SEQ ID NO: 137) | WASTRES (SEQ ID NO: 143) | QNDYRPFT (SEQ ID NO: 151) | SEQ ID NO: 6 |

TABLE 2-continued

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| 265E6G2 | KSSQSLLNSGNQKNYLT (SEQ ID NO: 136) | WASTRES (SEQ ID NO: 143) | QNDYSYPLP (SEQ ID NO: 152) | SEQ ID NO: 8 |
| 250F4G4 | KSSQSLFNSGNQKNYLT (SEQ ID NO: 137) | WASTRES (SEQ ID NO: 143) | QNDYWYPFT (SEQ ID NO: 153) | SEQ ID NO: 10 |
| 262C7C10 | KSSQSLLNSGNQKNYLT (SEQ ID NO: 136) | WASTRES (SEQ ID NO: 143) | QNDYYYPLT (SEQ ID NO: 154) | SEQ ID NO: 12 |
| 240F8G2 | KSSQSLLNSGNQKNYLT (SEQ ID NO: 136) | WASTRES (SEQ ID NO: 143) | QNDYYYPLT (SEQ ID NO: 154) | SEQ ID NO: 282 |
| 232C5E3 | KSSQSLLNSGNQKNYLT (SEQ ID NO: 136) | WASTRES (SEQ ID NO: 143) | QNGYRFPFT (SEQ ID NO: 155) | SEQ ID NO: 14, 353, 354 |
| 252E7C9 | KSSQSLLNSGNQKNYLT (SEQ ID NO: 136) | WASTRES (SEQ ID NO: 143) | QNNFRYPFT (SEQ ID NO: 156) | SEQ ID NO: 16 |
| 257G7B9 | KSSQSLFNSGNQKNYLT (SEQ ID NO: 137) | WASTRES (SEQ ID NO: 143) | QNNYWFPFT (SEQ ID NO: 157) | SEQ ID NO: 18 |
| 241H10A1 | KSSQSLLNSGNQKNYLT (SEQ ID NO: 136) | WAATRES (SEQ ID NO: 144) | QNDYFYPFT (SEQ ID NO: 158) | SEQ ID NO: 20 |
| 273C10E5 | KSSQSLLNSGNQKNYLT (SEQ ID NO: 136) | WAATRES (SEQ ID NO: 144) | QNDYFYPFT (SEQ ID NO: 158) | SEQ ID NO: 22 |
| 234A10F7 | KSSQSLLNSGNQKNYLT (SEQ ID NO: 136) | WAATRES (SEQ ID NO: 144) | QNDYFYPFT (SEQ ID NO: 158) | SEQ ID NO: 496 |
| 240D6F5 | KSSQSLFNSGNQKNYLT (SEQ ID NO: 137) | WASTRES (SEQ ID NO: 143) | QNDYRYPFT (SEQ ID NO: 151) | SEQ ID NO: 498 |
| 242H12D6 | KSSQSLFNSGNQKNYLT (SEQ ID NO: 137) | WASTRES (SEQ ID NO: 143) | QNDYRYPFT (SEQ ID NO: 151) | SEQ ID NO: 500 |
| 243B4F2 | KSSQSLFNSGNQKNYLT (SEQ ID NO: 137) | WASTRES (SEQ ID NO: 143) | QNNYWFPFT (SEQ ID NO: 157) | SEQ ID NO: 502 |
| 243B4F7 | KSSQSLFNSGNQKNYLT (SEQ ID NO: 137) | WASTRES (SEQ ID NO: 143) | QNNYWFPFT (SEQ ID NO: 157) | SEQ ID NO: 504 |
| 243F6D2 | KSSQSLLNSGNQKNYLT (SEQ ID NO: 136) | WASTRES (SEQ ID NO: 143) | QNNYRYPFT (SEQ ID NO: 455) | SEQ ID NO: 506 |
| 250F4G1 | KSSQSLFNSGNQKNYLT (SEQ ID NO: 137) | WASTRES (SEQ ID NO: 143) | QNDYWYPFT (SEQ ID NO: 153) | SEQ ID NO: 508 |
| 257F1E11 | KSSQSLFNSGNQKNYLT (SEQ ID NO: 137) | WASTRES (SEQ ID NO: 143) | QNDYWYPFT (SEQ ID NO: 153) | SEQ ID NO: 510 |
| 257G7F7 | KSSQSLFNSGNQKNYLT (SEQ ID NO: 137) | WASTRES (SEQ ID NO: 143) | QNNYWFPFT (SEQ ID NO: 157) | SEQ ID NO: 512 |
| 260F8A6 | KSSQSLLNSGNQKNYLT (SEQ ID NO: 136) | WASTRES (SEQ ID NO: 143) | QNNYMYPFT (SEQ ID NO: 249) | SEQ ID NO: 514 |
| 268D7H9 | KSSQSLLNSGNQKNYLT (SEQ ID NO: 136) | WASTRES (SEQ ID NO: 143) | QNDYYYPLT (SEQ ID NO: 154) | SEQ ID NO: 516 |
| 271B1B6 | KSSQSLLNSGNQKNYLT (SEQ ID NO: 136) | WASTRES (SEQ ID NO: 143) | QNDYYYPLT (SEQ ID NO: 154) | SEQ ID NO: 518 |
| 275H9A2 | KSSQSLLNSGNQKNYLT (SEQ ID NO: 136) | WASTRES (SEQ ID NO: 143) | QNNFRYPFT (SEQ ID NO: 156) | SEQ ID NO: 520 |

TABLE 2-continued

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| Consensus | KSSQSLX$_{19}$NSGNQKNYLT<br>X$_{19}$ = L, F<br>(SEQ ID NO: 186) | WAX$_{20}$TRES<br>X$_{20}$ = S, A<br>(SEQ ID NO: 187) | QNX$_{21}$X$_{22}$X$_{23}$X$_{24}$PX$_{25}$X$_{26}$<br>X$_{21}$ = D, G, N<br>X$_{22}$ = Y, F<br>X$_{23}$ = M, R, S, W, Y, F<br>X$_{24}$ = F, Y<br>X$_{25}$ = F, L<br>X$_{26}$ = T, P<br>(SEQ ID NO: 188) | |
| Model | KSSQSLLNSGNQKNYLT<br>(SEQ ID NO: 136) | WASTRES<br>(SEQ ID NO: 143) | QNDYRYPFT<br>(SEQ ID NO: 151) | |

GROUP 2

| Antibody | VL CDR1 | VL CDR2 | VL CDR3 | VL |
|---|---|---|---|---|
| 185F2G12 | KSSQSLFNTGNQKNYLT (SEQ ID NO: 138) | RASTRES (SEQ ID NO: 145) | QNDFSYPLT (SEQ ID NO: 159) | SEQ ID NO: 24 |
| 194D3B2 | KSSQSLLNSGNQKNYLT (SEQ ID NO: 136) | RASTRES (SEQ ID NO: 145) | QNDYSYPLT (SEQ ID NO: 160) | SEQ ID NO: 26 |
| 207F8G5 | KSSQSLFNSGNQKNYLI (SEQ ID NO: 139) | RASTRDS (SEQ ID NO: 146) | QNDYSYPLT (SEQ ID NO: 160) | SEQ ID NO: 28, 346, 347 |
| 222B6G5 | KSSQSLFNSGNQKNYLI (SEQ ID NO: 139) | RASTRDS (SEQ ID NO: 146) | QNDYSYPLT (SEQ ID NO: 160) | SEQ ID NO: 30 |
| 182D10F1 | KSSQSLFNSGNQKNYLT (SEQ ID NO: 137) | RASTRES (SEQ ID NO: 145) | QNDYSYPLT (SEQ ID NO: 160) | SEQ ID NO: 32 |
| 234B9D4 | KSSQSLLNSGNQENYLT (SEQ ID NO: 140) | RASTROS (SEQ ID NO: 147) | QNDYSYPLT (SEQ ID NO: 160) | SEQ ID NO: 34 |
| 253E4F7 | KSSQSLLNSGNQKNYLT (SEQ ID NO: 136) | RASTROS (SEQ ID NO: 147) | QNDYSYPLT (SEQ ID NO: 160) | SEQ ID NO: 36 |
| 198F10B8 | KSSQSLFNSGNQKNYLT (SEQ ID NO: 137) | RASTRES (SEQ ID NO: 145) | QNDYSYPLT (SEQ ID NO: 160) | SEQ ID NO: 264 |
| 213B10A4 | KSSQSLLNSGNQKNYLT (SEQ ID NO: 136) | RASTRES (SEQ ID NO: 145) | QNDYSYPLT (SEQ ID NO: 160) | SEQ ID NO: 266 |
| Consensus | KSSQSLX$_{41}$NX$_{42}$GNQX$_{43}$NYLX$_{44}$<br>X$_{41}$ = F, L<br>X$_{42}$ = T, S<br>X$_{43}$ = K, E<br>X$_{44}$ = T, I<br>(SEQ ID NO: 189) | RASTRX$_{45}$S<br>X45 = E, D, Q<br>(SEQ ID NO: 190) | QNDX$_{46}$SYPLT<br>X$_{46}$ = F, Y<br>(SEQ ID NO: 191) | |
| Model | KSSQSLFNSGNQKNYLT (SEQ ID NO: 137) | RASTRES (SEQ ID NO: 145) | QNDYSYPLT (SEQ ID NO: 160) | |

GROUP 3

| Antibody | VL CDR1 | VL CDR2 | VL CDR3 | VL |
|---|---|---|---|---|
| 370E2B12C3 | KSSQTLLNSGNQKNYLT (SEQ ID NO: 141) | WASTGES (SEQ ID NO: 148) | QNAYFYPFT (SEQ ID NO: 161) | SEQ ID NO: 38, 375-377 |
| 237D2A4 | KSSQSLLNSGNQKNYLT (SEQ ID NO: 136) | WASTRES (SEQ ID NO: 143) | QNDYSFPLT (SEQ ID NO: 162) | SEQ ID NO: 40, 363, 364 |
| 203A6C9 | KSSQSLLNSGNQKNYLT (SEQ ID NO: 136) | WASTRDS (SEQ ID NO: 149) | QNNYIYPLT (SEQ ID NO: 163) | SEQ ID NO: 42 |
| 201F4H6 | KSSQSLLNSGNQKSYLT (SEQ ID NO: 142) | WASTRES (SEQ ID NO: 143) | QNVYFFPFT (SEQ ID NO: 164) | SEQ ID NO: 44 |

TABLE 2-continued

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| 200A4H8 | KSSQSLLNSGNQKNYLT (SEQ ID NO: 136) | WASTRDS (SEQ ID NO: 149) | QNNYIYPLT (SEQ ID NO: 163) | SEQ ID NO: 522 |
| 203A6D5 | KSSQSLLNSGNQKNYLT (SEQ ID NO: 136) | WASTRDS (SEQ ID NO: 149) | QNNYIYPLT (SEQ ID NO: 163) | SEQ ID NO: 524 |
| 248G8E8 | KSSQSLLNSGNQKNYLT (SEQ ID NO: 136) | WASTRES (SEQ ID NO: 143) | QNDYSFPLT (SEQ ID NO: 162) | SEQ ID NO: 536 |
| Consensus | KSSQX$_{64}$LLNSGNQKX$_{65}$YLT<br>X$_{64}$ = T, S<br>X$_{65}$ = N, S<br>(SEQ ID NO: 192) | WASTX$_{66}$X$_{67}$S<br>X$_{66}$ = G, R<br>X$_{67}$ = E, D<br>(SEQ ID NO: 193) | QNX$_{68}$YX$_{69}$X$_{70}$PX$_{71}$T<br>X$_{68}$ = A, D, N, V<br>X$_{69}$ = F, S, I<br>X$_{70}$ = Y, F<br>X$_{71}$ = F, L<br>(SEQ ID NO: 194) | |
| Model | KSSQSLLNSGNQKNYLT (SEQ ID NO: 136) | WASTRES (SEQ ID NO: 143) | QNAYFYPFT (SEQ ID NO: 161) | |
| GROUP 4 | | | | |
| 429H6C5 | KSSQSLLNSGNQKNYLT (SEQ ID NO: 136) | WASTRES (SEQ ID NO: 143) | QNAYIYPLT (SEQ ID NO: 165) | SEQ ID NO: 48 |
| 407D8G1 | KSSQSLLNSGNQKNYLT (SEQ ID NO: 136) | WASTRES (SEQ ID NO: 143) | QNAYSFPLT (SEQ ID NO: 166) | SEQ ID NO: 50 |
| 419B5G9 | KSSQSLLNSGNQKNYLT (SEQ ID NO: 136) | WASTRES (SEQ ID NO: 143) | QNAYSYPLT (SEQ ID NO: 167) | SEQ ID NO: 52 |
| 393C2C5 | KSSQTLLNSGNQKNYLT (SEQ ID NO: 141) | WASTRES (SEQ ID NO: 143) | QNAYSYPVT (SEQ ID NO: 168) | SEQ ID NO: 54 |
| 412B6E4 | KSSQSLLNSGNQKNYLT (SEQ ID NO: 136) | WASTRES (SEQ ID NO: 143) | QNAYTYPLT (SEQ ID NO: 169) | SEQ ID NO: 56, 386, 387 |
| 414A5F7 | KSSQTLLNSGNQKNYLT (SEQ ID NO: 141) | WASTRES (SEQ ID NO: 143) | QNAYYYPLT (SEQ ID NO: 170) | SEQ ID NO: 58 |
| 418D2F9 | KSSQSLLNSGNQKNYLT (SEQ ID NO: 136) | WASTRES (SEQ ID NO: 143) | QNDYSYPLT (SEQ ID NO: 160) | SEQ ID NO: 60 |
| 410H6H3 | KSSQSLLNSGNQKNYLT (SEQ ID NO: 136) | WASTRES (SEQ ID NO: 143) | QNNYYYPLT (SEQ ID NO: 171) | SEQ ID NO: 62, 381, 382 |
| 391F1G2 | KSSQTLLNSGNQKNYLT (SEQ ID NO: 141) | WASTRES (SEQ ID NO: 143) | QNAYYYPLT (SEQ ID NO: 170) | SEQ ID NO: 528 |
| 406F11G8 | KSSQTLLNSGNQKNYLT (SEQ ID NO: 141) | WASTRES (SEQ ID NO: 143) | QNAYYYPLT (SEQ ID NO: 170) | SEQ ID NO: 530 |
| 410A9A9 | KSSQTLLNSGNQKNYLT (SEQ ID NO: 141) | WASTRES (SEQ ID NO: 143) | QNAYSYPVT (SEQ ID NO: 168) | SEQ ID NO: 532 |
| 410D9G2 | KSSQSLLNSGNQKNYLT (SEQ ID NO: 136) | WASTRES (SEQ ID NO: 143) | QNAYSFPLT (SEQ ID NO: 166) | SEQ ID NO: 534 |
| 416F12F3 | KSSQSLLNSGNQKNYLT (SEQ ID NO: 136) | WASTRES (SEQ ID NO: 143) | QNAYTYPLT (SEQ ID NO: 169) | SEQ ID NO: 536 |
| 420H3H9 | KSSQSLLNSGNQKNYLT (SEQ ID NO: 136) | WASTRES (SEQ ID NO: 143) | QNAYTYPLT (SEQ ID NO: 169) | SEQ ID NO: 538 |
| 411G12G1 | KSSQSLLNSGNQKNYLT (SEQ ID NO: 136) | WASTRES (SEQ ID NO: 143) | QNDYSFPLT (SEQ ID NO: 162) | SEQ ID NO: 540 |
| | KSSQTLLNSGNQKNYLT (SEQ ID NO: 141) | WASTRES (SEQ ID NO: 143) | QNAYSYPVT (SEQ ID NO: 168) | SEQ ID NO: 542 |
| 391H11H3 | KSSQSLLNSGNQKNYLT (SEQ ID NO: 136) | WASTRES (SEQ ID NO: 143) | QNAYSFPLT (SEQ ID NO: 166) | SEQ ID NO: 544 |

TABLE 2-continued

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| 395B3C11 | KSSQSLLNSGNQKNYLT (SEQ ID NO: 136) | WASTRES (SEQ ID NO: 143) | QNAYSFPLT (SEQ ID NO: 166) | SEQ ID NO: 546 |
| 406E1H7 | KSSQSLLNSGNQKNYLT (SEQ ID NO: 136) | WASTRES (SEQ ID NO: 143) | QNAYSFPLT (SEQ ID NO: 166) | SEQ ID NO: 548 |
| 414H6G2 | KSSQSLLNSGNQKNYLT (SEQ ID NO: 136) | WASTRES (SEQ ID NO: 143) | QNAYSFPLT (SEQ ID NO: 166) | SEQ ID NO: 550 |
| 420G10G3 | KSSQSLLNSGNQKNYLT (SEQ ID NO: 136) | WASTRES (SEQ ID NO: 143) | QNAYSFPLT (SEQ ID NO: 166) | SEQ ID NO: 552 |
| 422E8F9 | KSSQSLLNSGNQKNYLT (SEQ ID NO: 136) | WASTRES (SEQ ID NO: 143) | QNAYSFPLT (SEQ ID NO: 166) | SEQ ID NO: 554 |
| 422F4B6 | KSSQTLLNSGNQKNYLT (SEQ ID NO: 141) | WASTRES (SEQ ID NO: 143) | QNAYSYPLT (SEQ ID NO: 167) | SEQ ID NO: 556 |
| 425B3D5 | KSSQSLLNSGNQKNYLT (SEQ ID NO: 136) | WASTRES (SEQ ID NO: 143) | QNAYSFPLT (SEQ ID NO: 166) | SEQ ID NO: 558 |
| 425C6D3 | KSSQSLLNSGNQKNYLT (SEQ ID NO: 136) | WASTRES (SEQ ID NO: 143) | QNAYSFPLT (SEQ ID NO: 166) | SEQ ID NO: 560 |
| 426H6E11 | KSSQTLLNSGNQKNYLT (SEQ ID NO: 141) | WASTRES (SEQ ID NO: 143) | QNAYSFPLT (SEQ ID NO: 166) | SEQ ID NO: 562 |
| Consensus | KSSQX$_{86}$LLNSGNQKNYLT<br>X$_{86}$ = S, T<br>(SEQ ID NO: 195) | WASTRES (SEQ ID NO: 143) | QNX$_{87}$YX$_{88}$X$_{89}$PX$_{90}$T<br>X$_{87}$ = A, D, N<br>X$_{88}$ = I, S, T, Y<br>X$_{89}$ = Y, F<br>X$_{90}$ = L, V<br>(SEQ ID NO: 196) | |
| Model | KSSQSLLNSGNQKNYLT (SEQ ID NO: 136) | WASTRES (SEQ ID NO: 143) | QNAYSYPLT (SEQ ID NO: 167) | |
| OTHERS | | | | |
| 59B6C4 | KSSQSLLNSGNQKNYLT (SEQ ID NO: 136) | WASTRES (SEQ ID NO: 143) | QNAYSYPFT (SEQ ID NO: 172) | SEQ ID NO: 68 |
| 246B5F2 (IgM) | KSSQSLLNSGNQKNYLT (SEQ ID NO: 136) | WASTRES (SEQ ID NO: 143) | QNAYSYPFT (SEQ ID NO: 172) | SEQ ID NO: 46, 370, 371 |
| 418G6A5 | KSSQSLLNSGNQKNYLT (SEQ ID NO: 136) | WASTRES (SEQ ID NO: 143) | QNAYSYPLT (SEQ ID NO: 167) | SEQ ID NO: 64 |
| 417A6F11 | KSSQSLLNSGNQKNYLT (SEQ ID NO: 136) | WASTRES (SEQ ID NO: 143) | QNDYSYPT (SEQ ID NO: 173) | SEQ ID NO: 66 |
| 28C5B1 | KASQDVSTAVA (SEQ ID NO: 233) | SASYRYT (SEQ ID NO: 241) | QQHYSTPRT (SEQ ID NO: 242) | SEQ ID NO: 337252 |
| 35E8D2 | KSSQSLLNSGNQKNYLT (SEQ ID NO: 136) | WASTRES (SEQ ID NO: 143) | QNSYSFPLT (SEQ ID NO: 243) | SEQ ID NO: 254 |
| 61H12G10 | KSSQSLFNSGNLKNYLT (SEQ ID NO: 234) | WASTRES (SEQ ID NO: 143) | QNDYSYPFT (SEQ ID NO: 244) | SEQ ID NO: 256 |
| 69D5C1 | KSSQSLLNSGNLRNYLT (SEQ ID NO: 235) | WASTRES (SEQ ID NO: 143) | QNGYSYPFT (SEQ ID NO: 245) | SEQ ID NO: 258 |
| 181C7B2 | KSSQSLLNSGNQKNYLT (SEQ ID NO: 136) | WASTRES (SEQ ID NO: 143) | QNNYIYPLT (SEQ ID NO: 163) | SEQ ID NO: 260 |
| 196A12B10 | KSSQSLLNGGNQKNYLT (SEQ ID NO: 236) | WASTRES (SEQ ID NO: 143) | QNNYYFPLT (SEQ ID NO: 246) | SEQ ID NO: 262 |
| 232D7C8 | KSSQSLFNSGNQRNYLT (SEQ ID NO: 237) | WASTRES (SEQ ID NO: 143) | QNDYRYPFT (SEQ ID NO: 151) | SEQ ID NO: 268 |

TABLE 2-continued

Amino acid sequence (or sequence ID number) of light chain Variable
region (VL) or VL CDRs of Claudin18.2 antibodies

| Antibody | VL CDR1 | VL CDR2 | VL CDR3 | VL |
|---|---|---|---|---|
| 233D5E5 | KSSQSLFNSGNQKNYLT (SEQ ID NO: 137) | WASTRES (SEQ ID NO: 143) | QNAYWYPFT (SEQ ID NO: 247) | SEQ ID NO: 270 |
| 232F1E4 | KSSQSLLNSGNQKNYLT (SEQ ID NO: 136) | WASTRES (SEQ ID NO: 143) | QNDYIYPLT (SEQ ID NO: 248) | SEQ ID NO: 272 |
| 231H4G11 | KSSQSLFNSGSQKNYLT (SEQ ID NO: 238) | WASTRES (SEQ ID NO: 143) | QNNYWFPFT (SEQ ID NO: 157) | SEQ ID NO: 274 |
| 226A4B5 | KSSQSLFNSGNQKNYLT (SEQ ID NO: 137) | RASTRES (SEQ ID NO: 145) | QNDYSYPLT (SEQ ID NO: 160) | SEQ ID NO: 276 |
| 235A10C9 | KSSQSLLNSGNQKNYLT (SEQ ID NO: 136) | WASTRES (SEQ ID NO: 143) | QNDYMFPFT (SEQ ID NO: 150) | SEQ ID NO: 278 |
| 239H12G9 | KSSQSLLNSGNQKNYLT (SEQ ID NO: 136) | WASTRES (SEQ ID NO: 143) | QNDYRYPFT (SEQ ID NO: 151) | SEQ ID NO: 280 |
| 248E6A7 | KSSQSLLNSGNQKNYLA (SEQ ID NO: 239) | WASTRES (SEQ ID NO: 143) | QNNYMYPFT (SEQ ID NO: 249) | SEQ ID NO: 284 |
| 254A8D5 | RSSQSLLNSGNQKNYLT (SEQ ID NO: 240) | WASTRES (SEQ ID NO: 143) | QNGYSYPFT (SEQ ID NO: 245) | SEQ ID NO: 286 |
| 259C6F4 | KSSQSLLNSGNQKNYLT (SEQ ID NO: 136) | WASTRES (SEQ ID NO: 143) | QNAYRFPFT (SEQ ID NO: 250) | SEQ ID NO: 288 |
| 280F3B6 | KSSQSLFNSGNQKNYLT (SEQ ID NO: 137) | WASTRES (SEQ ID NO: 143) | QNDYWYPFT (SEQ ID NO: 153) | SEQ ID NO: 290 |
| 59B6C9E8 | KSSQSLLNSGNQKNYLT (SEQ ID NO: 136) | WASTRES (SEQ ID NO: 143) | QNAYSYPFT (SEQ ID NO: 172) | SEQ ID NO: 564 |
| 186F7E10 | KSSQSLLNSGNQKNYLT (SEQ ID NO: 136) | WASTRES (SEQ ID NO: 143) | QNNYIYPLT (SEQ ID NO: 163) | SEQ ID NO: 566 |
| 186G12H3 | KSSQSLLNSGNQKNYLT (SEQ ID NO: 136) | WASTRES (SEQ ID NO: 143) | QNNYIYPLT (SEQ ID NO: 163) | SEQ ID NO: 568 |
| 194A2F7 | KSSQNLLNSGNQKSYLT (SEQ ID NO: 456) | WASTRET (SEQ ID NO: 457) | QNAYRFPFT (SEQ ID NO: 250) | SEQ ID NO: 570 |
| 217D9G2 | RSSQSLFNSGNQKNYLI (SEQ ID NO: 458) | RASTRDS (SEQ ID NO: 146) | QNDYSYPLT (SEQ ID NO: 160) | SEQ ID NO: 572 |
| 219F9B8 | KSSQSLLNSGNQKNYLT (SEQ ID NO: 136) | RASTRES (SEQ ID NO: 145) | QNDYSYPLT (SEQ ID NO: 160) | SEQ ID NO: 574 |
| 231C11E9 | RSSQSLLNSGNQKNYLT (SEQ ID NO: 240) | WASTRES (SEQ ID NO: 143) | QNDYSYPFT (SEQ ID NO: 244) | SEQ ID NO: 576 |
| 234C9G5 | KSSQSLFNSGNQKNYLT (SEQ ID NO: 137) | WASTRES (SEQ ID NO: 143) | QNNYWFPFT (SEQ ID NO: 157) | SEQ ID NO: 578 |
| 234E1F12 | KSSQSLFNSGNQKNYLT (SEQ ID NO: 137) | WASTRES (SEQ ID NO: 143) | QNAYWYPFT (SEQ ID NO: 247) | SEQ ID NO: 580 |
| 240A8E7 | KSSQSLLNSGNQKNYLT (SEQ ID NO: 136) | WASTRES (SEQ ID NO: 143) | QNDYYYPFT (SEQ ID NO: 459) | SEQ ID NO: 582 |
| 242F5H2 | RSSQSLLNSGNQKNYLT (SEQ ID NO: 240) | WASTRES (SEQ ID NO: 143) | QNGYSYPFT (SEQ ID NO: 245) | SEQ ID NO: 584 |
| 244A1B8 | KSSQSLLNSGNQKNYLT (SEQ ID NO: 136) | WASTRES (SEQ ID NO: 143) | QNDYRYPFT (SEQ ID NO: 151) | SEQ ID NO: 586 |
| 252C10F6 | RASQSISDYLH (SEQ ID NO: 460) | YASQSIS (SEQ ID NO: 461) | QNGHSFPFT (SEQ ID NO: 462) | SEQ ID NO: 588 |
| 256C3D3 | KSSQSLFNSGNQKNYLT (SEQ ID NO: 137) | WASTRES (SEQ ID NO: 143) | QNNYWFPFT (SEQ ID NO: 157) | SEQ ID NO: 590 |
| 258D11C4 | KSSQSLFNSGNQKNYLT (SEQ ID NO: 137) | WASTRQS (SEQ ID NO: 463) | QNDYWFPFT (SEQ ID NO: 464) | SEQ ID NO: 592 |

TABLE 2-continued

Amino acid sequence (or sequence ID number) of light chain Variable region (VL) or VL CDRs of Claudin18.2 antibodies

| Antibody | VL CDR1 | VL CDR2 | VL CDR3 | VL |
|---|---|---|---|---|
| 259B4D4 | NSSQSLLNSGNQKNYLT (SEQ ID NO: 465) | WASSRES (SEQ ID NO: 466) | QNDYSFPLT (SEQ ID NO: 162) | SEQ ID NO: 594 |
| 259C6F7 | KSSQSLLNSGNQKNYLT (SEQ ID NO: 136) | WASTRES (SEQ ID NO: 143) | QNAYRFPFT (SEQ ID NO: 250) | SEQ ID NO: 596 |
| 262H9H6 | KSSQSLFNSGNQKNYLT (SEQ ID NO: 137) | WASTRES (SEQ ID NO: 143) | QNNYWFPFT (SEQ ID NO: 157) | SEQ ID NO: 598 |
| 263E9F3 | KSSQSLLNSGNQENYLT (SEQ ID NO: 140) | RASTRQS (SEQ ID NO: 147) | QNDYSYPLT (SEQ ID NO: 160) | SEQ ID NO: 600 |
| 266B11F7 | KSSQSLLNSGNQKNYLT (SEQ ID NO: 136) | WASTRES (SEQ ID NO: 143) | QNDYIFPLT (SEQ ID NO: 467) | SEQ ID NO: 602 |
| 267B2C5 | KSSQSLLNSGNQKNYLT (SEQ ID NO: 136) | WASTRES (SEQ ID NO: 143) | QNDYIYPLT (SEQ ID NO: 248) | SEQ ID NO: 604 |
| 267H5F12 | KSSQSLFNSGNQKNYLT (SEQ ID NO: 137) | WASTRES (SEQ ID NO: 143) | QNNYWFPFT (SEQ ID NO: 157) | SEQ ID NO: 606 |
| 273F3D4 | KSSQSLLNSGNQKNYLT (SEQ ID NO: 136) | WASTRES (SEQ ID NO: 143) | QNDYIYPLT (SEQ ID NO: 248) | SEQ ID NO: 608 |
| 275B2G2 | KSSQSLLNSGNQKNYLT (SEQ ID NO: 136) | WASTRES (SEQ ID NO: 143) | QNDYSYPFT (SEQ ID NO: 244) | SEQ ID NO: 610 |
| 277F1F8 | KSSQSLLNSGNQKNYLT (SEQ ID NO: 136) | WASTRES (SEQ ID NO: 143) | QNDYRFPFT (SEQ ID NO: 468) | SEQ ID NO: 612 |
| 286C7F11 | KSSQSLLNSGNQKNYLT (SEQ ID NO: 136) | WASTRES (SEQ ID NO: 143) | LNDYYYPLT (SEQ ID NO: 469) | SEQ ID NO: 614 |
| 292D9C7 | KSSQSLLNSGNQKNYLT (SEQ ID NO: 136) | WASTRES (SEQ ID NO: 143) | QNDYYYPLT (SEQ ID NO: 154) | SEQ ID NO: 616 |
| 392A11C8 | RSSQSLLNSGNQKNYLT (SEQ ID NO: 240) | WASTRES (SEQ ID NO: 143) | QNAYSFPLT (SEQ ID NO: 166) | SEQ ID NO: 618 |
| 392C2F10 | KSSQSLLNSGNQKNYLT (SEQ ID NO: 136) | WASTRES (SEQ ID NO: 143) | QSDYSYPT (SEQ ID NO: 470) | SEQ ID NO: 620 |
| 394C2G5 | KSSQSLLNSGNQKNYLT (SEQ ID NO: 136) | WASTRES (SEQ ID NO: 143) | QNAYSFPLT (SEQ ID NO: 166) | SEQ ID NO: 622 |
| 405G8F11 | KSSQSLLNSGNQKNYLT (SEQ ID NO: 136) | WASTRES (SEQ ID NO: 143) | QSAFSYPLT (SEQ ID NO: 471) | SEQ ID NO: 624 |
| 406G3C4 | SASSSISYMH (SEQ ID NO: 472) | DTSKLAS (SEQ ID NO: 473) | QQWSSNPLT (SEQ ID NO: 474) | SEQ ID NO: 626 |
| 407A8G10 | RSSQSLLNSGNQRNYLT (SEQ ID NO: 475) | WASTRES (SEQ ID NO: 143) | QNAYSFPLT (SEQ ID NO: 166) | SEQ ID NO: 628 |
| 407E11H8 | RSSQNLLNSGNLKNYLT (SEQ ID NO: 476) | WASTRES (SEQ ID NO: 143) | QNAYSFPLT (SEQ ID NO: 166) | SEQ ID NO: 630 |
| 407H12E6 | KSSQSLLNSGNQKNYLT (SEQ ID NO: 136) | WASTRES (SEQ ID NO: 143) | QNNYFFPLT (SEQ ID NO: 477) | SEQ ID NO: 632 |
| 409D1A7 | KSSQSLLNSGNQRNYLT (SEQ ID NO: 478) | WASTRES (SEQ ID NO: 143) | QNAYSFPLT (SEQ ID NO: 166) | SEQ ID NO: 634 |
| 409G10G6 | RSSQSLLNSGNQRNYLT (SEQ ID NO: 475) | WASTRES (SEQ ID NO: 143) | QNAYSFPLT (SEQ ID NO: 166) | SEQ ID NO: 636 |
| 411A6E3 | RSSQNLLNSGNLKNYLT (SEQ ID NO: 476) | WASTRES (SEQ ID NO: 143) | QNAYSFPLT (SEQ ID NO: 166) | SEQ ID NO: 638 |
| 411B4G4 | RSSQSLLNSGNQRNYLT (SEQ ID NO: 475) | WASTRES (SEQ ID NO: 143) | QNAYSFPLT (SEQ ID NO: 166) | SEQ ID NO: 640 |
| 411G3E10 | RSSQSLLNSGNQKNYLT (SEQ ID NO: 240) | WASTRES (SEQ ID NO: 143) | QNAYSFPLT (SEQ ID NO: 166) | SEQ ID NO: 642 |

TABLE 2-continued

Amino acid sequence (or sequence ID number) of light chainVariable region (VL) orVL CDRs of Claudin18.2 antibodies

| Antibody | VL CDR1 | VL CDR2 | VL CDR3 | VL |
|---|---|---|---|---|
| 413B1C9 | KSSQSLFNRGNQKSYLT (SEQ ID NO: 479) | WASTRES (SEQ ID NO: 143) | QNNYIYPLT (SEQ ID NO: 163) | SEQ ID NO: 644 |
| 413C12F8 | RSSQSLLNSGNQKNYLT (SEQ ID NO: 240) | WASTRES (SEQ ID NO: 143) | QNAYSFPLT (SEQ ID NO: 166) | SEQ ID NO: 646 |
| 413H4G12 | KSSQSLLNSGNQKNYLT (SEQ ID NO: 136) | WASTRES (SEQ ID NO: 143) | QSDYSYPT (SEQ ID NO: 470) | SEQ ID NO: 648 |
| 418B11D3 | SASSSISYMH (SEQ ID NO: 472) | DTSKLAS (SEQ ID NO: 473) | QQWSSNPLT (SEQ ID NO: 474) | SEQ ID NO: 650 |
| 418B8B10 | KSSQSLFNRGNQKSYLT (SEQ ID NO: 479) | WASTRES (SEQ ID NO: 143) | QNNYIYPLT (SEQ ID NO: 163) | SEQ ID NO: 652 |
| 419A10D4 | KSSQSLLNSGNQRNYLT (SEQ ID NO: 478) | WASTRES (SEQ ID NO: 143) | QNAYSFPLT (SEQ ID NO: 166) | SEQ ID NO: 654 |
| 419A5F3 | RSSQSLLNSGNQRNYLT (SEQ ID NO: 475) | WASTRES (SEQ ID NO: 143) | QNAYSFPLT (SEQ ID NO: 166) | SEQ ID NO: 656 |
| 420D5H5 | KSSQSLLNSGNQKNYLT (SEQ ID NO: 136) | WASTRES (SEQ ID NO: 143) | QNAYSFPLT (SEQ ID NO: 166) | SEQ ID NO: 658 |
| 420F12G8 | RSSQNLLNSGNQKNYLT (SEQ ID NO: 480) | WASTRES (SEQ ID NO: 143) | QNAYSFPFT (SEQ ID NO: 481) | SEQ ID NO: 660 |
| 420H7E6 | RSSQSLFNSGNQKNYLT (SEQ ID NO: 482) | WASTRES (SEQ ID NO: 143) | QTGFSYPLT (SEQ ID NO: 483) | SEQ ID NO: 662 |
| 421H4G3 | RSSQSLLNSGNQRNYLT (SEQ ID NO: 475) | WASTRES (SEQ ID NO: 143) | QNAYSFPLT (SEQ ID NO: 166) | SEQ ID NO: 664 |
| 423B2B5 | KSSQSLLNSGNQKNYLT (SEQ ID NO: 136) | WASTRES (SEQ ID NO: 143) | QNDYSYPLT (SEQ ID NO: 160) | SEQ ID NO: 668 |
| 423C10E1 | RSSQSLFNSGNQKNYLT (SEQ ID NO: 482) | WASTRES (SEQ ID NO: 143) | QTSFNYPLT (SEQ ID NO: 484) | SEQ ID NO: 670 |
| 424G9G3 | RSSQSIVYGNGNTYLE (SEQ ID NO: 485) | KVSSRFS (SEQ ID NO: 486) | FQGSHVPFT (SEQ ID NO: 487) | SEQ ID NO: 672 |
| 426D9F6 | KSSQSLLNSGNQRNYLT (SEQ ID NO: 478) | WASTRES (SEQ ID NO: 143) | QNAYSFPLT (SEQ ID NO: 166) | SEQ ID NO: 674 |
| 427C7H2 | SVSSSISSSNLH (SEQ ID NO: 488) | GTSNLAS (SEQ ID NO: 489) | QQWSSYPLT (SEQ ID NO: 490) | SEQ ID NO: 676 |
| 430A11H9 | RASENIYSYLA (SEQ ID NO: 491) | NAKTLAE (SEQ ID NO: 492) | QHHYGTPYT (SEQ ID NO: 493) | SEQ ID NO: 678 |
| 430B3F1 | KSSQSLLNSGNQKNYLT (SEQ ID NO: 136) | WASTRES (SEQ ID NO: 143) | QNAYSFPLT (SEQ ID NO: 166) | |
| 279E8B8 | KSSQSLLNSGNQKNYLT (SEQ ID NO: 136) | WASTRES (SEQ ID NO: 143) | QNDYMYPFT (SEQ ID NO: 494) | SEQ ID NO: 680 |

In some embodiments, a Claudin18.2-binding moiety comprises an antibody. In some embodiments, a Claudin18.2-binding moiety comprises a humanized antibody. In some embodiments, a Claudin18.2-binding moiety comprises an antibody having a VH CDR1, VH CDR2, VH CDR3, VL CDR1, VL CDR2, and/or VL CDR3 from an antibody described herein. In some embodiments, a Claudin18.2-binding moiety comprises a humanized version of an antibody described herein. In some embodiments, a Claudin18.2-binding moiety comprises a variant of an anti-Claudin18.2 antibody described herein. In some embodiments, a variant of the anti-Claudin18.2 antibody comprises one to thirty conservative amino acid substitutions. In some embodiments, a variant of the anti-Claudin18.2 antibody comprises one to twenty-five conservative amino acid substitutions. In some embodiments, a variant of the anti-Claudin18.2 antibody comprises one to twenty conservative amino acid substitutions. In some embodiments, a variant of the anti-Claudin18.2 antibody comprises one to fifteen conservative amino acid substitutions. In some embodiments, a variant of the anti-Claudin18.2 antibody comprises one to ten conservative amino acid substitution(s). In some embodiments, a variant of the anti-Claudin18.2 antibody comprises one to five conservative amino acid substitution(s). In some embodiments, a variant of the anti-Claudin18.2 antibody comprises one to three conservative amino acid substitution(s). In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, a Claudin18.2-binding moiety comprises: (a) a heavy chain variable region (VH) comprising (1) a VH CDR1 comprising the amino acid sequence selected from the group consisting of SEQ ID NOs:69-88, 203-210, 392, 397, 402, 406, 409, 413, 417, 427, 430, 433, 434, 436, 444, 447, and 450 or a variant thereof comprising 1, 2, 3, or 4 amino acid substitutions; (2) a VH CDR2 comprising the amino acid sequence selected from the group consisting of SEQ ID NOs:89-116, 201, 202, 211-224, 390, 391, 393, 395, 398, 400, 401, 403, 405, 407, 410, 412, 414, 418, 419, 421, 423, 425, 426, 428, 432, 435, 437, 438, 439, 440, 442, 445, 448, 451, and 453, or a variant thereof comprising 1, 2, 3, or 4 amino acid substitutions; and (3) a VH CDR3 comprising the amino acid sequence selected from the group consisting of SEQ ID NOs:117-135, 225-232, 394, 396, 399, 404, 408, 411, 415, 416, 420, 422, 424, 429, 431, 441, 443, 446, 449, 452, and 454, or a variant thereof comprising 1, 2, 3, or 4 amino acid substitutions; and/or a light chain variable region (VL) comprising (1) a VL CDR1 comprising the amino acid sequence selected from the group consisting of SEQ ID NOs:136-142, 233-240, 456, 458, 460, 465, 472, 475, 476, 478, 479, 480, 482, 485, 488, and 491, or a variant thereof comprising 1, 2, 3, or 4 amino acid substitutions; (2) a VL CDR2 comprising the amino acid sequence selected from the group consisting of SEQ ID NOs:143-149, 241, 457, 461, 463, 466, 473, 486, 489, and 492, or a variant thereof comprising 1, 2, 3, or 4 amino acid substitutions; (3) a VL CDR3 comprising the amino acid sequence selected from the group consisting of SEQ ID NOs:150-173, 242-250, 455, 459, 462, 464, 467, 468, 469, 470, 471, 474, 477, 470, 474, 481, 483, 484, 487, 490, 493, and 494, or a variant thereof comprising 1, 2, 3, or 4 amino acid substitutions. In some embodiments, a CDR (VH CDR1, VH CDR2, VH CDR3, VL CDR1, VL CDR2 and/or VL CDR3) comprises one amino acid substitution. In some embodiments, a CDR (VH CDR1, VH CDR2, VH CDR3, VL CDR1, VL CDR2 and/or VL CDR3) comprises two amino acid substitutions. In some embodiments, a CDR (VH CDR1, VH CDR2, VH CDR3, VL CDR1, VL CDR2 and/or VL CDR3) comprises three amino acid substitutions. In some embodiments, a CDR (VH CDR1, VH CDR2, VH CDR3, VL CDR1, VL CDR2 and/or VL CDR3) comprises four amino acid substitutions. In some embodiments, the one or more amino acid substitutions are conservative substitutions. In some embodiments, the one or more substitutions are made as part of a humanization process. In some embodiments, the one or more substitutions are made as part of a germline humanization process. In some embodiments, the one or more substitutions are made as part of an affinity maturation process. In some embodiments, the one or more substitutions are made as part of an optimization process.

In some embodiments, a Claudin18.2-binding moiety comprises an antibody having a VH CDR1, VH CDR2, VH CDR3, VL CDR1, VL CDR2, and/or VL CDR3 from an antibody described herein as Group 1 antibody, including 260G9E8, 252F1B10, 257B1G9, 265E6G2, 250F4G4, 262C7C10, 240F8G2, 232C5E3, 252E7C9, 257G7B9, 241H10A1, and 273C10E5. In some embodiments, a Claudin18.2-binding moiety comprises a VH CDR1, CDR2, and CDR3, and/or VL CDR1, CDR2, and CDR3 from a Group 1 antibody described herein, or a humanized version thereof. In some embodiments, a Claudin18.2-binding moiety comprises a VH CDR1, CDR2, and CDR3 from a Group 1 antibody described herein. In some embodiments, a Claudin18.2-binding moiety comprises a VL CDR1, CDR2, and CDR3 from a Group 1 antibody described herein. In some embodiments, a Claudin18.2-binding moiety comprises a VH CDR1, CDR2, and CDR3, and VL CDR1, CDR2, and CDR3 from a Group 1 antibody described herein. In some embodiments, a Claudin18.2-binding moiety is a humanized version of a Group 1 antibody described herein. In some embodiments, a Claudin18.2-binding moiety is a variant of a Group 1 antibody described herein.

In some embodiments, a Claudin18.2-binding moiety comprises a humanized version of a Group 1 antibody described herein. In some embodiments, a Claudin18.2-binding moiety comprises a variant of a Group 1 anti-Claudin18.2 antibody described herein. In some embodiments, a variant of the anti-Claudin18.2 antibody comprises 1 to 30, 1 to 25, 1 to 20, 1 to 15, 1 to 10, 1 to 5, or 1 to 3 conservative amino acid substitutions. In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, provided herein are binding moiety that specifically binds to Claudin18.2, comprising (a) a heavy chain variable region (VH) comprising (1) a heavy chain CDR1 (VH CDR1) comprising $X_1X_2X_3X_4X_5$, wherein $X_1$ is S or N; $X_2$ is H, Y, or F; $X_3$ is N or G; $X_4$ is M, I, or L; and $X_5$ is H or N (SEQ ID NO: 174); (2) a heavy chain CDR2 (VH CDR2) comprising $X_6IX_7PGX_8GX_9X_{10}X_{11}YNX_{12}X_{13}FX_{14}X_{15}$, wherein $X_6$ is Y or W; $X_7$ is Y or F; $X_8$ is N or D; $X_9$ or G, R, or N; $X_{10}$ is T, N, or S; $X_{11}$ is K, N, or Y; $X_{12}$ is Q or E; $X_{13}$ is K or N; $X_{14}$ is T or K; and $X_{15}$ is G or A (SEQ ID NO:175); and (3) a heavy chain CDR3 (VH CDR3) comprising $X_{16}YYGNSFX_{17}X_{18}$, wherein $X_{16}$ is D or F; $X_{17}$ is A or V; and $X_{18}$ is Y or N (SEQ ID NO:176); and/or (b) a light chain variable region (VL) comprising (1) a light chain CDR1 (VL CDR1) comprising $KSSQSLX_{19}NSGNQKNYLT$, wherein $X_{19}$ is L or F (SEQ ID NO:186); (2) a light chain CDR2 (VL CDR2) comprising $WAX_{20}TRES$, wherein $X_{20}$ is S or A (SEQ ID NO:187); and (3) a light chain CDR3 (VL CDR3) comprising $QNX_{21}X_{22}X_{23}X_{24}PX_{25}X_{26}$, wherein $X_{21}$ is D, G, or N; $X_{22}$ is Y or F; $X_{23}$ is M, R, S, W, Y, or F; $X_{24}$ is F or Y; $X_{25}$ is F or L; and $X_{26}$ is T or P (SEQ ID NO:188).

In some embodiments, a Claudin18.2-binding moiety comprises (a) the VH comprises (1) a VH CDR1 comprising SHNMH (SEQ ID NO:69); (2) a VH CDR2 comprising YIYPGNGGTNYNQKFKG (SEQ ID NO: 90); and (3) DYYGNSFAY (SEQ ID NO:117); and/or (b) the VL comprises (1) a VL CDR1 comprising KSSQSLLNSGNQK-NYLT (SEQ ID NO:136); (2) a VL CDR2 comprising WASTRES (SEQ ID NO:143); and (3) a VL CDR3 comprising QNDYRYPFT (SEQ ID NO:151).

In some embodiments, a Claudin18.2-binding moiety comprises a VH comprising a VH CDR1, VH CDR2, and VH CDR3, comprising the amino acid sequences of SEQ ID NOs:69, 89, and 117, respectively, or a variant thereof comprising up to about 5 amino acid substitutions in the CDRs; and/or a VL comprising a VL CDR1, VL CDR2, and VL CDR3, comprising the amino acid sequences of SEQ ID NOs:136, 143, and 150, respectively, or a variant thereof comprising up to about 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID In some embodiments, a Claudin18.2-binding moiety comprises a VH comprising a VH CDR1, VH CDR2, and VH CDR3, comprising the amino acid sequences of SEQ ID NOs:69, 90, and 117, respectively, or a variant thereof comprising up to about 5 amino acid substitutions in the CDRs; and/or a VL comprising a VL CDR1, VL CDR2, and VL CDR3, comprising the amino acid sequences of SEQ ID NOs:137, 143, and 151, respectively, or a variant thereof comprising up to about 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:70, 90, and 117, respectively, or a variant thereof comprising up to about 5 amino acid substitutions in the CDRs; and/or a VL comprising a VL CDR1, VL CDR2, and VL CDR3, comprising the amino acid sequences of SEQ ID NOs:136, 143, and 152, respectively, or a variant thereof comprising up to about 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 91, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 143, and 153, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:71, 92, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 154, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:72, 93, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 155, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 94, and 118, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 156, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:73, 95, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 143, and 157, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:74, 96, and 119, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 144, and 158, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprising the amino acid sequences of SEQ ID NOs: 74, 96, and 130, respectively; and/or a VL comprising a VL CDR1, CDR2, and CDR3 comprising the amino acid sequences of SEQ ID NOs: 136, 144, and 158, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprising the amino acid sequences of SEQ ID NOs: 69, 202, and 118, respectively; and/or a VL comprising a VL CDR1, CDR2, and CDR3 comprising the amino acid sequences of SEQ ID NOs: 136, 143, and 455, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprising the amino acid sequences of SEQ ID NOs: 72, 90, and 117, respectively; and/or a VL comprising a VL CDR1, CDR2, and CDR3 comprising the amino acid sequences of SEQ ID NOs: 137, 143, and 153, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprising the amino acid sequences of SEQ ID NOs: 69, 390, and 118, respectively; and/or (b) a VL comprising a VL CDR1, CDR2, and CDR3 comprising the amino acid sequences of SEQ ID NOs: 136, 143, and 249, respectively, or a variant thereof comprising 1, 2, 3, 4 or 5 amino acid substitutions in the CDRs.

In some embodiments, a Claudin18.2-binding moiety comprises an antibody having a VH CDR1, VH CDR2, VH CDR3, VL CDR1, VL CDR2, and/or VL CDR3 from an antibody described herein as Group 2 antibody, namely, 185F2G12, 194D3B2, 207F8G5, 222B6G5, 182D10F1, 234B9D4, 253E4F7, 241H10A1, or 273C10E5.

In some embodiments, a Claudin18.2-binding moiety comprises a VH CDR1, CDR2, and CDR3, and/or VL CDR1, CDR2, and CDR3 from a Group 2 antibody described herein, or a humanized version thereof. In some embodiments, a Claudin18.2-binding moiety comprises a VH CDR1, CDR2, and CDR3 from a Group 2 antibody described herein. In some embodiments, a Claudin18.2-binding moiety comprises a VL CDR1, CDR2, and CDR3 from a Group 2 antibody described herein. In some embodiments, a Claudin18.2-binding moiety comprises a VH CDR1, CDR2, and CDR3, and VL CDR1, CDR2, and CDR3 from a Group 2 antibody described herein. In some embodiments, a Claudin18.2-binding moiety is a humanized version of a Group 2 antibody described herein. In some embodiments, a Claudin18.2-binding moiety is a variant of a Group 2 antibody described herein.

In some embodiments, a Claudin18.2-binding moiety comprises a humanized version of a Group 2 antibody described herein. In some embodiments, a Claudin18.2- binding moiety comprises a variant of a Group 2 anti-Claudin18.2 antibody described herein. In some embodiments, a variant of the anti-Claudin18.2 antibody comprises 1 to 30, 1 to 25, 1 to 20, 1 to 15, 1 to 10, 1 to 5, or 1 to 3 conservative amino acid substitutions. In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, provided herein are binding moiety that specifically binds to Claudin18.2, comprising (a) a VH comprising (1) a VH CDR1 comprising SYX$_{27}$X$_{28}$H, wherein X$_{27}$=is N or Y; and X$_{28}$ is M or I (SEQ ID NO: 177); (2) a VH CDR2 comprising YIX$_{29}$PX$_{30}$NGGX$_{31}$X$_{32}$YX$_{33}$X$_{34}$KFX$_{35}$X$_{36}$, wherein X$_{29}$ is Y, S, or D; X$_{30}$ is G or F; X$_{31}$ is T or S; X$_{32}$ is N, Y, or R; X$_{33}$ is S or N; X$_{34}$ is Q or L; X$_{35}$ is K, R, or E; X$_{36}$ is G or D (SEQ ID NO:178); and (3) a VH CDR3 comprising X$_{37}$RX$_{38}$X$_{39}$X$_{40}$Y, wherein X$_{37}$ is G or L; X$_{38}$ is G or F; X$_{39}$ is F or L; X$_{40}$ is A or T (SEQ ID NO:179); and/or (b) a VL comprising (1) VL CDR1 comprising KSSQSLX$_{41}$NX$_{42}$GNQX$_{43}$NYLX$_{44}$, wherein X$_{41}$ is F or L; X$_{42}$ is T or S; X$_{43}$ is K or E; and X$_{44}$ is T or I (SEQ ID NO:189); (2) a VL CDR2 comprising RASTRX$_{45}$S, wherein X$_{45}$ is E, D, or Q (SEQ ID NO:190); and (3) a VL CDR3 comprising QNDX$_{46}$SYPLT, wherein X$_{46}$ is F or Y (SEQ ID NO:191).

In some embodiments, provided herein are binding moiety that specifically binds to Claudin18.2, comprising a VH comprising (1) a VH CDR1 comprising SYNTH (SEQ ID NO:75); (2) a VH CDR2 comprising YIYPGNGGTNYNQKFKG (SEQ ID NO: 90); and (3) GRGFAY (SEQ ID NO:120); and/or (b) a VL comprising (1) a VL CDR1 comprising KSSQSLFNSGNQKNYLT (SEQ ID NO:137); (2) a VL CDR2 comprising RASTRES (SEQ ID NO:145); and (3) a VL CDR3 comprising QNDYSYPLT (SEQ ID NO:160).

In some embodiments, a Claudin18.2-binding moiety comprises a VH comprising a VH CDR1, VH CDR2, and VH CDR3, comprising the amino acid sequences of SEQ ID NOs:70, 97, and 120, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:138, 145, and 159, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:70, 98, and 120, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 145, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:75, 99, and 120, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:139, 146, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:75, 100, and 120, respectively, or a variant thereof comprising 1, 2, 3, 4 or 5 amino acid substitutions in the CDRs. and/or a VL comprising a VL CDR1, VL CDR2, and VL CDR3, comprising the amino acid sequences of SEQ ID NOs:139, 146, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:70, 90, and 121, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 145, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:76, 101, and 122, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:140, 147, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:76, 101, and 123, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 147, and 160, respectively, or a variant thereof comprising 1, 2, 3, 4 or 5 amino acid substitutions in the CDRs.

In some embodiments, a Claudin18.2-binding moiety comprises an antibody having a VH CDR1, VH CDR2, VH CDR3, VL CDR1, VL CDR2, and/or VL CDR3 from an antibody described herein as Group 3 antibody, including 370E2B12C3, 237D2A4, 203A6C9, and 201F4H6.

In some embodiments, a Claudin18.2-binding moiety comprises a VH CDR1, CDR2, and CDR3, and/or VL CDR1, CDR2, and CDR3 from a Group 3 antibody described herein, or a humanized version thereof. In some embodiments, a Claudin18.2-binding moiety comprises a VH CDR1, CDR2, and CDR3 from a Group 3 antibody described herein. In some embodiments, a Claudin18.2-binding moiety comprises a VL CDR1, CDR2, and CDR3 from a Group 3 antibody described herein. In some embodiments, a Claudin18.2-binding moiety comprises a VH CDR1, CDR2, and CDR3, and VL CDR1, CDR2, and CDR3 from a Group 3 antibody described herein. In some embodiments, a Claudin18.2-binding moiety is a humanized version of a Group 3 antibody described herein. In some embodiments, a Claudin18.2-binding moiety is a variant of a Group 3 antibody described herein.

In some embodiments, a Claudin18.2-binding moiety comprises a humanized version of a Group 3 antibody described herein. In some embodiments, a Claudin18.2- binding moiety comprises a variant of a Group 3 anti-Claudin18.2 antibody described herein. In some embodiments, a variant of the anti-Claudin18.2 antibody comprises 1 to 30, 1 to 25, 1 to 20, 1 to 15, 1 to 10, 1 to 5, or 1 to 3 conservative amino acid substitutions. In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, provided herein are binding moiety that specifically binds to Claudin18.2, comprising (a) a VH comprising (1) a VH CDR1 comprising $X_{47}$YGV$X_{48}$, wherein $X_{47}$ is T, S, or R, and $X_{48}$, H or S (SEQ ID NO: 180); (2) a VH CDR2 comprising VIW$X_{49}X_{50}$G$X_{51}$T$X_{52}$Y$X_{53}X_{54}X_{55}X_{56}X_{57}$S, wherein $X_{49}$ is A, G, or S; $X_{50}$ is G or D; $X_{51}$ is S or N; $X_{52}$ is N or D; $X_{53}$ is N or H; $X_{54}$ is S or A; $X_{55}$ is A or T; $X_{56}$ is L or F; and $X_{57}$ is M or I (SEQ ID NO:181); and (3) a VH CDR3 comprising $X_{58}X_{59}X_{60}X_{61}$GN$X_{62}X_{63}$DY, wherein $X_{58}$ is A or null; $X_{59}$ is A, G, or V; $X_{60}$ is Y or R; $X_{61}$ is Y, F or null; $X_{62}$ is A, G, or S; and $X_{63}$ is L, F, or M (SEQ ID NO:182); and/or (b) a VL comprising (1) a VL CDR1 comprising KSSQX$_{64}$LLNSGNQK$X_{65}$YLT, wherein $X_{64}$ is T or S; and $X_{65}$ is N or S (SEQ ID NO:192); (2) a VL CDR2 comprising WAST$X_{66}X_{67}$S, wherein $X_{66}$ is G or R; and $X_{67}$ is E or D (SEQ ID NO:193); and (3) a VL CDR3 comprising QN$X_{68}$Y$X_{69}X_{70}$P$X_{71}$T, wherein $X_{68}$ is A, D, N, or V; $X_{69}$ is F, S, or I; and $X_{70}$ is Y or F; and $X_{71}$ is F or L (SEQ ID NO:194).

In some embodiments, provided herein are binding moiety that specifically binds to Claudin18.2, comprising (a) a VH comprises (1) a VH CDR1 comprising SYGVS (SEQ ID NO:78); (2) a VH CDR2 comprising VIWAGGSTNYH-SALMS (SEQ ID NO: 197); and (3) AAYYGNALDY (SEQ ID NO:198); and/or (b) a VL comprises (1) a VL CDR1 comprising KSSQSLLNSGNQKNYLT (SEQ ID NO:136); (2) a VL CDR2 comprising WASTRES (SEQ ID NO:143); and (3) a VL CDR3 comprising QNAYFYPFT (SEQ ID NO:161).

In some embodiments, a Claudin18.2-binding moiety comprises a VH comprising a VH CDR1, VH CDR2, and VH CDR3, comprising the amino acid sequences of SEQ ID NOs:77, 102, and 124, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:141, 148, and 161, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:78, 103, and 125, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 162, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:79, 104, and 126, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 149, and 163, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:78, 105, and 127, respectively, or a variant thereof comprising 1, 2, 3, 4 or 5 amino acid substitutions in the CDRs. and/or a VL comprising a VL CDR1, VL CDR2, and VL CDR3, comprising the amino acid sequences of SEQ ID NOs:142, 143, and 164, respectively, or a variant thereof comprising 1, 2, 3, 4 or 5 amino acid substitutions in the CDRs.

In some embodiments, a Claudin18.2-binding moiety comprises a VH comprising VH CDR1, VH CDR2, and VH CDR3, comprising the amino acid sequences of SEQ ID NOs: 209, 103 and 125, respectively; and/or a VL comprising a VL CDR1, CDR2, and CDR3 comprising the amino acid sequences of SEQ ID NOs: 136, 143, and 162, respectively, or a variant thereof comprising 1, 2, 3, 4 or 5 amino acid substitutions in the CDRs.

In some embodiments, a Claudin18.2-binding moiety comprises an antibody having a VH CDR1, VH CDR2, VH CDR3, VL CDR1, VL CDR2, and/or VL CDR3 from an antibody described herein as Group 4 antibody, including 429H6C5, 407D8G1, 419B5G9, 393C2C5, 412B6E4, 414A5F7, 418D2F9, and 410H6H3.

In some embodiments, a Claudin18.2-binding moiety comprises a VH CDR1, CDR2, and CDR3, and/or VL CDR1, CDR2, and CDR3 from a Group 4 antibody described herein, or a humanized version thereof. In some embodiments, a Claudin18.2-binding moiety comprises a VH CDR1, CDR2, and CDR3 from a Group 4 antibody described herein. In some embodiments, a Claudin18.2-binding moiety comprises a VL CDR1, CDR2, and CDR3 from a Group 4 antibody described herein. In some embodiments, a Claudin18.2-binding moiety comprises a VH CDR1, CDR2, and CDR3, and VL CDR1, CDR2, and CDR3 from a Group 4 antibody described herein. In some embodiments, a Claudin18.2-binding moiety is a humanized version of a Group 4 antibody described herein. In some embodiments, a Claudin18.2-binding moiety is a variant of a Group 4 antibody described herein.

In some embodiments, a Claudin18.2-binding moiety comprises a humanized version of a Group 4 antibody described herein. In some embodiments, a Claudin18.2-binding moiety comprises a variant of a Group 4 anti-Claudin18.2 antibody described herein. In some embodiments, a variant of the anti-Claudin18.2 antibody comprises 1 to 30, 1 to 25, 1 to 20, 1 to 15, 1 to 10, 1 to 5, or 1 to 3 conservative amino acid substitutions. In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, provided herein are binding moiety that specifically binds to Claudin18.2, comprising (a) a VH comprising (1) a VH CDR1 comprising $X_{72}X_{73}$GMH, wherein $X_{72}$ is S, G, or T; and $X_{73}$ is F or S (SEQ ID NO: 183); (2) a VH CDR2 comprising YI$X_{74}X_{75}$GS$X_{76}X_{77}$I$X_{78}$YA$X_{79}X_{80}X_{81}X_{82}$G, wherein $X_{74}$ is S or N; $X_{75}$ is S, G, or T; $X_{76}$ is S, R, T, or N; $X_{77}$ is T, or P; $X_{78}$ is Y or F; $X_{79}$ is D or H; $X_{80}$ is T or S; $X_{81}$ is V or L; and $X_{82}$ is K or Q (SEQ ID NO:184), and (3) a VH CDR3 comprising $X_{83}$YYGNSF$X_{84}X_{85}$, wherein $X_{83}$ is F or I; $X_{84}$ is V, D, or A; and $X_{85}$ is Y, N, or H (SEQ ID NO:185);

and/or (b) a VL comprising (1) a VL CDR1 comprising SSQX$_{86}$LLNSGNQKNYLT, wherein X$_{86}$ is S or T (SEQ ID NO:195); (2) VL CDR2 comprising WASTRES (SEQ ID NO:143); and (3) a VL CDR3 comprising QNX$_{87}$YX$_{88}$X$_{89}$PX$_{90}$T, wherein X$_{87}$ is A, D, or N; X$_{88}$ is I, S, T, or Y; X$_{89}$ is Y or F; X$_{90}$ is L or V (SEQ ID NO:196).

In some embodiments, provided herein are binding moiety that specifically binds to Claudin18.2, comprising (a) a VH that comprises (1) a VH CDR1 comprising SGFTFSSFGMH (SEQ ID NO:80); (2) a VH CDR2 comprising YISSGSSTIYYADTVKG (SEQ ID NO: 199); and (3) FYYGNSFAY (SEQ ID NO:130); and/or (b) a VL that comprises (1) a VL CDR1 comprising KSSQSLLNSGNQKNYLT (SEQ ID NO:136); (2) a VL CDR2 comprising WASTRES (SEQ ID NO:143); and (3) a VL CDR3 comprising QNAYSYPLT (SEQ ID NO:167).

In some embodiments, a Claudin18.2-binding moiety comprises a VH comprising a VH CDR1, VH CDR2, and VH CDR3, comprising the amino acid sequences of SEQ ID NOs:80, 106, and 128, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 165, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:81, 107, and 129, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 166, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:82, 108, and 130, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 167, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:80, 109, and 130, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:141, 143, and 168, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:83, 110, and 130, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 169, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:80, 109, and 131, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:141, 143, and 170, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:80, 111, and 132, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:84, 112, and 132, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NO:136, 143, and 171, respectively, or a variant thereof comprising 1, 2, 3, 4 or 5 amino acid substitutions in the CDRs.

In some embodiments, a Claudin18.2-binding moiety comprises a VH comprising a VH CDR1, CDR2, and CDR3 comprising the amino acid sequences of SEQ ID NOs: 81, 391, and 129, respectively; and/or a VL comprising a VL CDR1, CDR2, and CDR3 comprising the amino acid sequences of SEQ ID NOs: 136, 143, and 162, respectively, or a variant thereof comprising 1, 2, 3, 4 or 5 amino acid substitutions in the CDRs.

In some embodiments, a Claudin18.2-binding moiety comprises a VH comprising a VH CDR1, CDR2, and CDR3 comprising the amino acid sequences of SEQ ID NOs: 80, 109, and 131, respectively; and/or a VL comprising a VL CDR1, CDR2, and CDR3 comprising the amino acid sequences of SEQ ID NOs: 141, 143, and 167, respectively, or a variant thereof comprising 1, 2, 3, 4 or 5 amino acid substitutions in the CDRs.

In some embodiments, a Claudin18.2-binding moiety comprises a VH comprising a VH CDR1, CDR2, and CDR3 comprising the amino acid sequences of SEQ ID NOs: 81, 107, and 129, respectively; and/or a VL comprising a VL CDR1, CDR2, and CDR3 comprising the amino acid sequences of SEQ ID NOs: 141, 143, and 166, respectively, or a variant thereof comprising 1, 2, 3, 4 or 5 amino acid substitutions in the CDRs.

In some embodiments, a Claudin18.2-binding moiety comprises an antibody having a VH CDR1, VH CDR2, VH CDR3, VL CDR1, VL CDR2, and/or VL CDR3 from an antibody designated as Group "Other" antibody, including 59B6C4, 246B5F2, 418G6A5, 417A6F11, 28C5B1, 35E8D2, 61H12G10, 69D5C1, 181C7B2, 196A12B10, 232D7C8, 233D5E5, 232F1E4, 231H4G11, 226A4B5, 235A10C9, 239H12G9, 248E6A7, 254A8D5, 259C6F4 or 280F3B6.

In some embodiments, a Claudin18.2-binding moiety comprises a VH CDR1, CDR2, and CDR3, and/or VL CDR1, CDR2, and CDR3 from a Group "Other" antibody described herein, or a humanized version thereof. In some embodiments, a Claudin18.2-binding moiety comprises a VH CDR1, CDR2, and CDR3 from a Group "Other" antibody described herein. In some embodiments, a Claudin18.2-binding moiety comprises a VL CDR1, CDR2, and CDR3 from a Group "Other" antibody described herein. In some embodiments, a Claudin18.2-binding moiety comprises a VH CDR1, CDR2, and CDR3, and VL CDR1, CDR2, and CDR3 from a Group "Other" antibody described herein. In some embodiments, a Claudin18.2-binding moiety is a humanized version of a Group "Other" antibody described herein. In some embodiments, a Claudin18.2-binding moiety is a variant of a Group "Other" antibody described herein.

In some embodiments, a Claudin18.2-binding moiety comprises a variant of a Group "Other" antibody described herein. In some embodiments, a variant of the anti-Claudin18.2 antibody comprises 1 to 30, 1 to 25, 1 to 20, 1 to 15, 1 to 10, 1 to 5, or 1 to 3 conservative amino acid substitutions. In some embodiments, the conservative amino acid substitution(s) is in a CDR of the antibody. In some embodiments, the conservative amino acid substitution(s) is not in a CDR of the antibody. In some embodiments, the conservative amino acid substitution(s) is in a framework region of the antibody.

In some embodiments, a Claudin18.2-binding moiety comprises a VH comprising a VH CDR1, VH CDR2, and VH CDR3, comprising the amino acid sequences of SEQ ID NOs:85, 113, and 133, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 172, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:86, 114, and 134, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 172, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:87, 115, and 131, respectively, or a variant thereof comprising 1, 2, 3, 4 or 5 amino acid substitutions in the CDRs. and/or a VL comprising a VL CDR1, VL CDR2, and VL CDR3, comprising the amino acid sequences of SEQ ID NOs:136, 143, and 167, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:88, 116, and 135, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 173, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:203, 211, and 225, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:233, 241, and 242, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:204, 212, and 226, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 243, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:205, 213, and 227, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:234, 143, and 244, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:206, 214, and 131, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:235, 143, and 245, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:207, 215, and 228, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 163, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:208, 216, and 229, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:236, 143, and 246, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 90, and 230, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:237, 143, and 151, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 217, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 143, and 247, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:209, 218, and 231, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 248, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:72, 219, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:238, 143, and 157, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:75, 220, and 120, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 145, and 160, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 221, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 150, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:72, 222, and 118, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 151, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 223, and 118, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:239, 143, and 249, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:210, 224, and 232, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:240, 143, and 245, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:72, 217, and 118, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:136, 143, and 250, respectively, or a variant thereof comprising 1, 2, 3, 4 or 5 amino acid substitutions in the CDRs.

In some embodiments, a Claudin18.2-binding moiety comprises a VH comprising a VH CDR1, VH CDR2, and VH CDR3, comprising the amino acid sequences of SEQ ID NOs:69, 90, and 117, respectively, or a variant thereof comprising 1, 2, 3, 4 or 5 amino acid substitutions in the CDRs; and/or a VL comprising a VL CDR1, VL CDR2, and VL CDR3, comprising the amino acid sequences of SEQ ID NOs:137, 143, and 153, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 85, 113, and 133, respectively; and/or a VL comprising VL CDR1, CDR2, and CDR3 comprising the amino acid sequences of SEQ ID NOs: 136, 143, and 172, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 392, 393, and 394, respectively; and/or a VL comprising VL CDR1, CDR2, and CDR3 comprising the amino acid sequences of SEQ ID NOs: 136, 143, and 163, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 392, 395, and 396, respectively; and/or a VL comprising VL CDR1, CDR2, and CDR3 comprising the amino acid sequences of SEQ ID NOs: 136, 143, and 163, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 397, 398, and 399, respectively; and/or a VL comprising VL CDR1, CDR2, and CDR3 comprising the amino acid sequences of SEQ ID NOs: 456, 457, and 250, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 75, 400, and 120, respectively; and/or a VL comprising VL CDR1, CDR2, and CDR3 comprising the amino acid sequences of SEQ ID NOs: 458, 146, and 160, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 70, 401, and 120, respectively; and/or a VL comprising VL CDR1, CDR2, and CDR3 comprising the amino acid sequences of SEQ ID NOs: 136, 145, and 160, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 402, 403, and 404, respectively; and/or a VL comprising VL CDR1, CDR2, and CDR3 comprising the amino acid sequences of SEQ ID NOs: 240, 143, and 244, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 69, 219, and 117, respectively; and/or a VL comprising VL CDR1, CDR2, and CDR3 comprising the amino acid sequences of SEQ ID NOs: 137, 143, and 157, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 71, 405, and 117, respectively; and/or a VL comprising VL CDR1, CDR2, and CDR3 comprising the amino acid sequences of SEQ ID NOs: 136, 143, and 459, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 406, 407, and 408, respectively; and/or a VL comprising VL CDR1, CDR2, and CDR3 comprising the amino acid sequences of SEQ ID NOs: 460, 461, and 462, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 69, 90, and 117, respectively; and/or a VL comprising VL CDR1, CDR2, and CDR3 comprising the amino acid sequences of SEQ ID NOs: 137, 463, and 464, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 409, 410, and 411, respectively; and/or a VL comprising VL CDR1, CDR2, and CDR3 comprising the amino acid sequences of SEQ ID NOs: 465, 466, and 162, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 69, 219, and 416, respectively; and/or a VL comprising VL CDR1, CDR2, and CDR3 comprising the amino acid sequences of SEQ ID NOs: 137, 143, and 157, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 76, 412, and 411, respectively; and/or a VL comprising VL CDR1, CDR2, and CDR3 comprising the amino acid sequences of SEQ ID NOs: 140, 147, and 160, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 413, 414, and 415, respectively; and/or a VL comprising VL CDR1, CDR2, and CDR3 comprising the amino acid sequences of SEQ ID NOs: 136, 143, and 467, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 417, 418, and 232, respectively; and/or a VL comprising VL CDR1, CDR2, and CDR3 comprising the amino acid sequences of SEQ ID NOs: 136, 143, and 244, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 69, 419, and 420, respectively; and/or a VL comprising VL CDR1, CDR2, and CDR3 comprising the amino acid sequences of SEQ ID NOs: 136, 143, and 468, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 205, 421, and 422, respectively; and/or a VL comprising VL CDR1, CDR2, and CDR3 comprising the amino acid sequences of SEQ ID NOs: 136, 143, and 469, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 205, 423, and 424, respectively; and/or a VL comprising VL CDR1, CDR2, and CDR3 comprising the amino acid sequences of SEQ ID NOs: 136, 143, and 154, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 391, and 129, respectively; and/or a VL comprising VL CDR1, CDR2, and CDR3 comprising the amino acid sequences of SEQ ID NOs: 240, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 88, 425, and 135, respectively; and/or a VL comprising VL CDR1, CDR2, and CDR3 comprising the amino acid sequences of SEQ ID NOs: 136, 143, and 470, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 426, and 129, respectively; and/or a VL comprising VL CDR1, CDR2, and CDR3 comprising the amino acid sequences of SEQ ID NOs: 136, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 109, and 130, respectively; and/or a VL comprising VL CDR1, CDR2, and CDR3 comprising the amino acid sequences of SEQ ID NOs: 136, 143, and 471, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 427, 428, and 429, respectively; and/or a VL comprising VL CDR1, CDR2, and CDR3 comprising the amino acid sequences of SEQ ID NOs: 472, 473, and 474, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 391, and 129, respectively; and/or a VL comprising VL CDR1, CDR2, and CDR3 comprising the amino acid sequences of SEQ ID NOs: 475, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 430, 391, and 431, respectively; and/or a VL comprising VL CDR1, CDR2, and CDR3 comprising the amino acid sequences of SEQ ID NOs: 476, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 109, and 129, respectively; and/or a VL comprising VL CDR1, CDR2, and CDR3 comprising the amino acid sequences of SEQ ID NOs: 136, 143, and 477, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 391, and 129, respectively; and/or a VL comprising VL CDR1, CDR2, and CDR3 comprising the amino acid sequences of SEQ ID NOs: 478, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 432, and 129, respectively; and/or a VL comprising VL CDR1, CDR2, and CDR3 comprising the amino acid sequences of SEQ ID NOs: 475, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 433, 391, and 129, respectively; and/or a VL comprising VL CDR1, CDR2, and CDR3 comprising the amino acid sequences of SEQ ID NOs: 475, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 109, and 129, respectively; and/or a VL comprising VL CDR1, CDR2, and CDR3 comprising the amino acid sequences of SEQ ID NOs: 479, 143, and 163, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 434, 435, and 129, respectively; and/or a VL comprising VL CDR1, CDR2, and CDR3 comprising the amino acid sequences of SEQ ID NOs: 240, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 436, 428, and 429, respectively; and/or a VL comprising VL CDR1, CDR2, and CDR3 comprising the amino acid sequences of SEQ ID NOs: 472, 473, and 474, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 437, and 129, respectively; and/or a VL comprising VL CDR1, CDR2, and CDR3 comprising the amino acid sequences of SEQ ID NOs: 479, 143, and 163, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 391, and 129, respectively; and/or a VL comprising VL CDR1, CDR2, and CDR3 comprising the amino acid sequences of SEQ ID NOs: 478, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 438, and 129, respectively; and/or a VL comprising VL CDR1, CDR2, and CDR3 comprising the amino acid sequences of SEQ ID NOs: 136, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 391, and 129, respectively; and/or a VL comprising VL CDR1, CDR2, and CDR3 comprising the amino acid sequences of SEQ ID NOs: 480, 143, and 481, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 439, and 441, respectively; and/or a VL comprising VL CDR1, CDR2, and CDR3 comprising the amino acid sequences of SEQ ID NOs: 482, 143, and 483, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 433, 391, and 431, respectively; and/or a VL comprising VL CDR1, CDR2, and CDR3 comprising the amino acid sequences of SEQ ID NOs: 475, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 442, and 443, respectively; and/or a VL comprising VL CDR1, CDR2, and CDR3 comprising the amino acid sequences of SEQ ID NOs: 136, 143, and 160, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 80, 440, and 441, respectively; and/or a VL comprising VL CDR1, CDR2, and CDR3 comprising the amino acid sequences of SEQ ID NOs: 482, 143, and 484, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 444, 445, and 446, respectively; and/or a VL comprising VL CDR1, CDR2, and CDR3 comprising the amino acid sequences of SEQ ID NOs: 485, 486, and 487, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 447, 448, and 449, respectively; and/or a VL comprising VL CDR1, CDR2, and CDR3 comprising the amino acid sequences of SEQ ID NOs: 488, 489, and 490, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 450, 451, and 452, respectively; and/or a VL comprising VL CDR1, CDR2, and CDR3 comprising the amino acid sequences of SEQ ID NOs: 491, 492, and 493, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 81, 453, and 129, respectively; and/or a VL comprising VL CDR1, CDR2, and CDR3 comprising the amino acid sequences of SEQ ID NOs: 136, 143, and 166, respectively, or a variant thereof comprising 1, 2, 3, 4 or 5 amino acid substitutions in the CDRs.

In some embodiments, a Claudin18.2-binding moiety comprises a VH comprising VH CDR1, CDR2, and CDR3 comprise the amino acid sequences of SEQ ID NOs: 69, 89, and 454, respectively; and/or a VL comprising VL CDR1, CDR2, and CDR3 comprising the amino acid sequences of SEQ ID NOs: 136, 143, and 494, respectively, or a variant thereof comprising 1, 2, 3, 4 or 5 amino acid substitutions in the CDRs.

In some embodiments, a Claudin18.2-binding moiety comprises an amino acid sequence that is at least about 80% sequence identity to the amino acid sequence selected from the group consisting of SEQ ID NOs: 1-68, 251-290, 337-387 and 495-680. In some embodiments, a Claudin18.2-binding moiety comprises an amino acid sequence that is at least about 85%, at least about 90%, at least about 95%, at least about 97%, or at least about 99% sequence identity to the amino acid sequence selected from the group consisting of SEQ ID NOs:1-68, 251-290, 337-387 and 495-680. In some embodiments, a Claudin18.2-binding moiety comprises an amino acid sequence that is at least about 85% sequence identity to the amino acid sequence selected from the group consisting of SEQ ID NOs: 1-68, 251-290, 337-387 and 495-680. In some embodiments, a Claudin18.2-binding moiety comprises an amino acid sequence that is at least about 90% sequence identity to the amino acid sequence selected from the group consisting of SEQ ID NOs: 1-68, 251-290, 337-387, and 495-680. In some embodiments, a Claudin18.2-binding moiety comprises an amino acid sequence that is at least about 95% sequence identity to the amino acid sequence selected from the group consisting of SEQ ID NOs: 1-68, 251-290, 337-387 and 495-680. In some embodiments, a Claudin18.2-binding moiety comprises an amino acid sequence that is at least about 97% sequence identity to the amino acid sequence selected from the group consisting of SEQ ID NOs: 1-68, 251-290, 337-387 and 495-680. In some embodiments, a Claudin18.2-binding moiety comprises an amino acid sequence that is at least about 99% sequence identity to the amino acid sequence selected from the group consisting of SEQ ID NOs: 1-68, 251-290, 337-387 and 495-680. In some embodiments, a Claudin18.2-binding moiety comprises an amino acid sequence that is the amino acid sequence selected from the group consisting of SEQ ID NOs: 1-68, 251-290, 337-387 and 495-680.

In some embodiments, a Claudin18.2-binding moiety comprises (i) a VH comprising an amino acid sequence having at least 80% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence having at least 80% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, a Claudin18.2-binding moiety comprises (i) a VH comprising an amino acid sequence having at least 85% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence having at least 85% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, a Claudin18.2-binding moiety comprises (i) a VH comprising an amino acid sequence having at least 90% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-

380 and 383-385; and/or (ii) a VL comprising an amino acid sequence having at least 90% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, a Claudin18.2-binding moiety comprises (i) a VH comprising an amino acid sequence having at least 95% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence having at least 95% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, a Claudin18.2-binding moiety comprises (i) a VH comprising an amino acid sequence having at least 98% sequence identity to an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence having at least 98% sequence identity to an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387. In some embodiments, a Claudin18.2-binding moiety comprises (i) a VH comprising an amino acid sequence selected from the group consisting of the odd numbered SEQ ID NOs: 1-68, 251-290 and 495-680, and both odd and even numbered SEQ ID NOs: 337-345, 348-352, 355-362, 365-369, 372-374, 378-380 and 383-385; and/or (ii) a VL comprising an amino acid sequence selected from the group consisting of the even numbered SEQ ID NOs: 1-68, 251-290 and 495-680, and SEQ ID NOs. 346, 347, 353, 354, 363, 364, 370, 371, 375, 376, 377, 381, 382, 386 and 387.

In some embodiments, a Claudin18.2-binding moiety comprises (i) a VH comprising an amino acid sequence having at least 80%, at least 85%, at least 90%, at least 95%, at least 98% sequence identity to SEQ ID NO: 1; and/or (ii) a VL comprising an amino acid sequence having at least 80%, at least 85%, at least 90%, at least 95%, at least 98% sequence identity to SEQ ID NO: 2. In some embodiments, a Claudin18.2-binding moiety comprises (i) a VH comprising SEQ ID NO: 1; and/or (ii) a VL comprising SEQ ID NO: 2.

In some embodiments, a Claudin18.2-binding moiety comprises (i) a VH comprising an amino acid sequence having at least 80%, at least 85%, at least 90%, at least 95%, at least 98% sequence identity to SEQ ID NO: 3; and/or (ii) a VL comprising an amino acid sequence having at least 80%, at least 85%, at least 90%, at least 95%, at least 98% sequence identity to SEQ ID NO: 4. In some embodiments, a Claudin18.2-binding moiety comprises (i) a VH comprising SEQ ID NO: 3; and/or (ii) a VL comprising SEQ ID NO: 4.

In some embodiments, a Claudin18.2-binding moiety comprises (i) a VH comprising an amino acid sequence having at least 80%, at least 85%, at least 90%, at least 95%, at least 98% sequence identity to SEQ ID NO: 5; and/or (ii) a VL comprising an amino acid sequence having at least 80%, at least 85%, at least 90%, at least 95%, at least 98% sequence identity to SEQ ID NO: 6. In some embodiments, a Claudin18.2-binding moiety comprises (i) a VH comprising SEQ ID NO: 5; and/or (ii) a VL comprising SEQ ID NO: 6.

In some embodiments, a Claudin18.2-binding moiety comprises (i) a VH comprising an amino acid sequence having at least 80%, at least 85%, at least 90%, at least 95%, at least 98% sequence identity to SEQ ID NO: 7; and/or (ii) a VL comprising an amino acid sequence having at least 80%, at least 85%, at least 90%, at least 95%, at least 98% sequence identity to SEQ ID NO: 8. In some embodiments, a Claudin18.2-binding moiety comprises (i) a VH comprising SEQ ID NO: 7; and/or (ii) a VL comprising SEQ ID NO: 8.

In some embodiments, a Claudin18.2-binding moiety comprises (i) a VH comprising an amino acid sequence having at least 80%, at least 85%, at least 90%, at least 95%, at least 98% sequence identity to SEQ ID NO: 9; and/or (ii) a VL comprising an amino acid sequence having at least 80%, at least 85%, at least 90%, at least 95%, at least 98% sequence identity to SEQ ID NO: 10. In some embodiments, a Claudin18.2-binding moiety comprises (i) a VH comprising SEQ ID NO: 9; and/or (ii) a VL comprising SEQ ID NO: 10.

In some embodiments, a Claudin18.2-binding moiety comprises (i) a VH comprising an amino acid sequence having at least 80%, at least 85%, at least 90%, at least 95%, at least 98% sequence identity to SEQ ID NO: 11; and/or (ii) a VL comprising an amino acid sequence having at least 80%, at least 85%, at least 90%, at least 95%, at least 98% sequence identity to SEQ ID NO: 12. In some embodiments, a Claudin18.2-binding moiety comprises (i) a VH comprising SEQ ID NO: 11; and/or (ii) a VL comprising SEQ ID NO: 12.

In some embodiments, a Claudin18.2-binding moiety comprises (i) a VH comprising an amino acid sequence having at least 80%, at least 85%, at least 90%, at least 95%, at least 98% sequence identity to SEQ ID NO: 13; and/or (ii) a VL comprising an amino acid sequence having at least 80%, at least 85%, at least 90%, at least 95%, at least 98% sequence identity to SEQ ID NO: 14. In some embodiments, a Claudin18.2-binding moiety comprises (i) a VH comprising SEQ ID NO: 13; and/or (ii) a VL comprising SEQ ID NO: 14.

In some embodiments, a Claudin18.2-binding moiety comprises (i) a VH comprising an amino acid sequence having at least 80%, at least 85%, at least 90%, at least 95%, at least 98% sequence identity to SEQ ID NO: 15; and/or (ii) a VL comprising an amino acid sequence having at least 80%, at least 85%, at least 90%, at least 95%, at least 98% sequence identity to SEQ ID NO: 16. In some embodiments, a Claudin18.2-binding moiety comprises (i) a VH comprising SEQ ID NO: 15; and/or (ii) a VL comprising SEQ ID NO: 16.

In some embodiments, a Claudin18.2-binding moiety comprises (i) a VH comprising an amino acid sequence having at least 80%, at least 85%, at least 90%, at least 95%, at least 98% sequence identity to SEQ ID NO: 17; and/or (ii) a VL comprising an amino acid sequence having at least 80%, at least 85%, at least 90%, at least 95%, at least 98% sequence identity to SEQ ID NO: 18. In some embodiments, a Claudin18.2-binding moiety comprises (i) a VH comprising SEQ ID NO: 17; and/or (ii) a VL comprising SEQ ID NO: 18.

In some embodiments, a Claudin18.2-binding moiety comprises (i) a VH comprising an amino acid sequence having at least 80%, at least 85%, at least 90%, at least 95%, at least 98% sequence identity to SEQ ID NO: 19; and/or (ii)

a VL comprising an amino acid sequence having at least 80%, at least 85%, at least 90%, at least 95%, at least 98% sequence identity to SEQ ID NO: 20. In some embodiments, a Claudin18.2-binding moiety comprises (i) a VH comprising SEQ ID NO: 19; and/or (ii) a VL comprising SEQ ID NO: 20.

In some embodiments, a Claudin18.2-binding moiety comprises (i) a VH comprising an amino acid sequence having at least 80%, at least 85%, at least 90%, at least 95%, at least 98% sequence identity to SEQ ID NO: 21; and/or (ii) a VL comprising an amino acid sequence having at least 80%, at least 85%, at least 90%, at least 95%, at least 98% sequence identity to SEQ ID NO: 22. In some embodiments, a Claudin18.2-binding moiety comprises (i) a VH comprising SEQ ID NO: 21; and/or (ii) a VL comprising SEQ ID NO: 22.

In some embodiments, a Claudin18.2-binding moiety comprises (i) a VH comprising an amino acid sequence having at least 80%, at least 85%, at least 90%, at least 95%, at least 98% sequence identity to SEQ ID NO: 23; and/or (ii) a VL comprising an amino acid sequence having at least 80%, at least 85%, at least 90%, at least 95%, at least 98% sequence identity to SEQ ID NO: 24. In some embodiments, a Claudin18.2-binding moiety comprises (i) a VH comprising SEQ ID NO: 23; and/or (ii) a VL comprising SEQ ID NO: 24.

In some embodiments, a Claudin18.2-binding moiety comprises (i) a VH comprising an amino acid sequence having at least 80%, at least 85%, at least 90%, at least 95%, at least 98% sequence identity to SEQ ID NO: 25; and/or (ii) a VL comprising an amino acid sequence having at least 80%, at least 85%, at least 90%, at least 95%, at least 98% sequence identity to SEQ ID NO: 26. In some embodiments, a Claudin18.2-binding moiety comprises (i) a VH comprising SEQ ID NO: 25; and/or (ii) a VL comprising SEQ ID NO: 26.

In some embodiments, a Claudin18.2-binding moiety comprises (i) a VH comprising an amino acid sequence having at least 80%, at least 85%, at least 90%, at least 95%, at least 98% sequence identity to SEQ ID NO:27; and/or (ii) a VL comprising an amino acid sequence having at least 80%, at least 85%, at least 90%, at least 95%, at least 98% sequence identity to SEQ ID NO: 28. In some embodiments, a Claudin18.2-binding moiety comprises (i) a VH comprising SEQ ID NO: 27; and/or (ii) a VL comprising SEQ ID NO: 28.

In some embodiments, a Claudin18.2-binding moiety comprises (i) a VH comprising an amino acid sequence having at least 80%, at least 85%, at least 90%, at least 95%, at least 98% sequence identity to SEQ ID NO: 29; and/or (ii) a VL comprising an amino acid sequence having at least 80%, at least 85%, at least 90%, at least 95%, at least 98% sequence identity to SEQ ID NO: 30. In some embodiments, a Claudin18.2-binding moiety comprises (i) a VH comprising SEQ ID NO: 29; and/or (ii) a VL comprising SEQ ID NO: 30.

In some embodiments, a Claudin18.2-binding moiety comprises (i) a VH comprising an amino acid sequence having at least 80%, at least 85%, at least 90%, at least 95%, at least 98% sequence identity to SEQ ID NO: 31; and/or (ii) a VL comprising an amino acid sequence having at least 80%, at least 85%, at least 90%, at least 95%, at least 98% sequence identity to SEQ ID NO: 32. In some embodiments, a Claudin18.2-binding moiety comprises (i) a VH comprising SEQ ID NO: 31; and/or (ii) a VL comprising SEQ ID NO: 32.

In some embodiments, a Claudin18.2-binding moiety comprises (i) a VH comprising an amino acid sequence having at least 80%, at least 85%, at least 90%, at least 95%, at least 98% sequence identity to SEQ ID NO: 33; and/or (ii) a VL comprising an amino acid sequence having at least 80%, at least 85%, at least 90%, at least 95%, at least 98% sequence identity to SEQ ID NO: 34. In some embodiments, a Claudin18.2-binding moiety comprises (i) a VH comprising SEQ ID NO: 33; and/or (ii) a VL comprising SEQ ID NO: 34.

In some embodiments, a Claudin18.2-binding moiety comprises (i) a VH comprising an amino acid sequence having at least 80%, at least 85%, at least 90%, at least 95%, at least 98% sequence identity to SEQ ID NO: 35; and/or (ii) a VL comprising an amino acid sequence having at least 80%, at least 85%, at least 90%, at least 95%, at least 98% sequence identity to SEQ ID NO: 36. In some embodiments, a Claudin18.2-binding moiety comprises (i) a VH comprising SEQ ID NO: 35; and/or (ii) a VL comprising SEQ ID NO: 36.

In some embodiments, a Claudin18.2-binding moiety comprises (i) a VH comprising an amino acid sequence having at least 80%, at least 85%, at least 90%, at least 95%, at least 98% sequence identity to SEQ ID NO: 37; and/or (ii) a VL comprising an amino acid sequence having at least 80%, at least 85%, at least 90%, at least 95%, at least 98% sequence identity to SEQ ID NO: 38. In some embodiments, a Claudin18.2-binding moiety comprises (i) a VH comprising SEQ ID NO: 37; and/or (ii) a VL comprising SEQ ID NO: 38.

In some embodiments, a Claudin18.2-binding moiety comprises (i) a VH comprising an amino acid sequence having at least 80%, at least 85%, at least 90%, at least 95%, at least 98% sequence identity to SEQ ID NO: 39; and/or (ii) a VL comprising an amino acid sequence having at least 80%, at least 85%, at least 90%, at least 95%, at least 98% sequence identity to SEQ ID NO: 40. In some embodiments, a Claudin18.2-binding moiety comprises (i) a VH comprising SEQ ID NO: 39; and/or (ii) a VL comprising SEQ ID NO: 40.

In some embodiments, a Claudin18.2-binding moiety comprises (i) a VH comprising an amino acid sequence having at least 80%, at least 85%, at least 90%, at least 95%, at least 98% sequence identity to SEQ ID NO: 41; and/or (ii) a VL comprising an amino acid sequence having at least 80%, at least 85%, at least 90%, at least 95%, at least 98% sequence identity to SEQ ID NO: 42. In some embodiments, a Claudin18.2-binding moiety comprises (i) a VH comprising SEQ ID NO: 41; and/or (ii) a VL comprising SEQ ID NO: 42.

In some embodiments, a Claudin18.2-binding moiety comprises (i) a VH comprising an amino acid sequence having at least 80%, at least 85%, at least 90%, at least 95%, at least 98% sequence identity to SEQ ID NO: 43; and/or (ii) a VL comprising an amino acid sequence having at least 80%, at least 85%, at least 90%, at least 95%, at least 98% sequence identity to SEQ ID NO: 44. In some embodiments, a Claudin18.2-binding moiety comprises (i) a VH comprising SEQ ID NO: 43; and/or (ii) a VL comprising SEQ ID NO: 44.

In some embodiments, a Claudin18.2-binding moiety comprises (i) a VH comprising an amino acid sequence having at least 80%, at least 85%, at least 90%, at least 95%, at least 98% sequence identity to SEQ ID NO: 45; and/or (ii) a VL comprising an amino acid sequence having at least 80%, at least 85%, at least 90%, at least 95%, at least 98% sequence identity to SEQ ID NO: 46. In some embodiments, a Claudin18.2-binding moiety comprises (i) a VH comprising SEQ ID NO: 45; and/or (ii) a VL comprising SEQ ID NO: 46.

In some embodiments, a Claudin18.2-binding moiety comprises (i) a VH comprising an amino acid sequence having at least 80%, at least 85%, at least 90%, at least 95%, at least 98% sequence identity to SEQ ID NO: 47; and/or (ii) a VL comprising an amino acid sequence having at least 80%, at least 85%, at least 90%, at least 95%, at least 98% sequence identity to SEQ ID NO: 48. In some embodiments, a Claudin18.2-binding moiety comprises (i) a VH comprising SEQ ID NO: 47; and/or (ii) a VL comprising SEQ ID NO: 48.

In some embodiments, a Claudin18.2-binding moiety comprises (i) a VH comprising an amino acid sequence having at least 80%, at least 85%, at least 90%, at least 95%, at least 98% sequence identity to SEQ ID NO: 49; and/or (ii) a VL comprising an amino acid sequence having at least 80%, at least 85%, at least 90%, at least 95%, at least 98% sequence identity to SEQ ID NO: 50. In some embodiments, a Claudin18.2-binding moiety comprises (i) a VH comprising SEQ ID NO: 49; and/or (ii) a VL comprising SEQ ID NO: 50.

In some embodiments, a Claudin18.2-binding moiety comprises (i) a VH comprising an amino acid sequence having at least 80%, at least 85%, at least 90%, at least 95%, at least 98% sequence identity to SEQ ID NO: 51; and/or (ii) a VL comprising an amino acid sequence having at least 80%, at least 85%, at least 90%, at least 95%, at least 98% sequence identity to SEQ ID NO: 52. In some embodiments, a Claudin18.2-binding moiety comprises (i) a VH comprising SEQ ID NO: 51; and/or (ii) a VL comprising SEQ ID NO: 52.

In some embodiments, a Claudin18.2-binding moiety comprises (i) a VH comprising an amino acid sequence having at least 80%, at least 85%, at least 90%, at least 95%, at least 98% sequence identity to SEQ ID NO: 53; and/or (ii) a VL comprising an amino acid sequence having at least 80%, at least 85%, at least 90%, at least 95%, at least 98% sequence identity to SEQ ID NO: 54. In some embodiments, a Claudin18.2-binding moiety comprises (i) a VH comprising SEQ ID NO: 53; and/or (ii) a VL comprising SEQ ID NO: 54.

In some embodiments, a Claudin18.2-binding moiety comprises (i) a VH comprising an amino acid sequence having at least 80%, at least 85%, at least 90%, at least 95%, at least 98% sequence identity to SEQ ID NO: 55; and/or (ii) a VL comprising an amino acid sequence having at least 80%, at least 85%, at least 90%, at least 95%, at least 98% sequence identity to SEQ ID NO: 56. In some embodiments, a Claudin18.2-binding moiety comprises (i) a VH comprising SEQ ID NO: 55; and/or (ii) a VL comprising SEQ ID NO: 56.

In some embodiments, a Claudin18.2-binding moiety comprises (i) a VH comprising an amino acid sequence having at least 80%, at least 85%, at least 90%, at least 95%, at least 98% sequence identity to SEQ ID NO: 57; and/or (ii) a VL comprising an amino acid sequence having at least 80%, at least 85%, at least 90%, at least 95%, at least 98% sequence identity to SEQ ID NO: 58. In some embodiments, a Claudin18.2-binding moiety comprises (i) a VH comprising SEQ ID NO: 57; and/or (ii) a VL comprising SEQ ID NO: 58.

In some embodiments, a Claudin18.2-binding moiety comprises (i) a VH comprising an amino acid sequence having at least 80%, at least 85%, at least 90%, at least 95%, at least 98% sequence identity to SEQ ID NO: 59; and/or (ii) a VL comprising an amino acid sequence having at least 80%, at least 85%, at least 90%, at least 95%, at least 98% sequence identity to SEQ ID NO: 60. In some embodiments, a Claudin18.2-binding moiety comprises (i) a VH comprising SEQ ID NO: 59; and/or (ii) a VL comprising SEQ ID NO: 60.

In some embodiments, a Claudin18.2-binding moiety comprises (i) a VH comprising an amino acid sequence having at least 80%, at least 85%, at least 90%, at least 95%, at least 98% sequence identity to SEQ ID NO: 61; and/or (ii) a VL comprising an amino acid sequence having at least 80%, at least 85%, at least 90%, at least 95%, at least 98% sequence identity to SEQ ID NO: 62. In some embodiments, a Claudin18.2-binding moiety comprises (i) a VH comprising SEQ ID NO: 61; and/or (ii) a VL comprising SEQ ID NO: 62.

In some embodiments, a Claudin18.2-binding moiety comprises (i) a VH comprising an amino acid sequence having at least 80%, at least 85%, at least 90%, at least 95%, at least 98% sequence identity to SEQ ID NO: 63; and/or (ii) a VL comprising an amino acid sequence having at least 80%, at least 85%, at least 90%, at least 95%, at least 98% sequence identity to SEQ ID NO: 64. In some embodiments, a Claudin18.2-binding moiety comprises (i) a VH comprising SEQ ID NO: 63; and/or (ii) a VL comprising SEQ ID NO: 64.

In some embodiments, a Claudin18.2-binding moiety comprises (i) a VH comprising an amino acid sequence having at least 80%, at least 85%, at least 90%, at least 95%, at least 98% sequence identity to SEQ ID NO: 65; and/or (ii) a VL comprising an amino acid sequence having at least 80%, at least 85%, at least 90%, at least 95%, at least 98% sequence identity to SEQ ID NO: 66. In some embodiments, a Claudin18.2-binding moiety comprises (i) a VH comprising SEQ ID NO: 65; and/or (ii) a VL comprising SEQ ID NO: 66.

In some embodiments, a Claudin18.2-binding moiety comprises (i) a VH comprising an amino acid sequence having at least 80%, at least 85%, at least 90%, at least 95%, at least 98% sequence identity to SEQ ID NO: 67; and/or (ii) a VL comprising an amino acid sequence having at least 80%, at least 85%, at least 90%, at least 95%, at least 98% sequence identity to SEQ ID NO: 68. In some embodiments, a Claudin18.2-binding moiety comprises (i) a VH comprising SEQ ID NO: 67; and/or (ii) a VL comprising SEQ ID NO: 68.

In some embodiments, a Claudin18.2-binding moiety comprises (i) a VH comprising an amino acid sequence having at least 80%, at least 85%, at least 90%, at least 95%, at least 98% sequence identity to SEQ ID NO: 251; and/or (ii) a VL comprising an amino acid sequence having at least 80%, at least 85%, at least 90%, at least 95%, at least 98% sequence identity to SEQ ID NO: 252. In some embodiments, a Claudin18.2-binding moiety comprises (i) a VH comprising SEQ ID NO: 251; and/or (ii) a VL comprising SEQ ID NO: 252.

In some embodiments, a Claudin18.2-binding moiety comprises (i) a VH comprising an amino acid sequence having at least 80%, at least 85%, at least 90%, at least 95%, at least 98% sequence identity to SEQ ID NO: 253; and/or (ii) a VL comprising an amino acid sequence having at least 80%, at least 85%, at least 90%, at least 95%, at least 98% sequence identity to SEQ ID NO: 254. In some embodiments, a Claudin18.2-binding moiety comprises (i) a VH comprising SEQ ID NO: 253; and/or (ii) a VL comprising SEQ ID NO: 254.

In some embodiments, a Claudin18.2-binding moiety comprises (i) a VH comprising an amino acid sequence having at least 80%, at least 85%, at least 90%, at least 95%, at least 98% sequence identity to SEQ ID NO: 255; and/or (ii) a VL comprising an amino acid sequence having at least 80%, at least 85%, at least 90%, at least 95%, at least 98% sequence identity to SEQ ID NO: 256. In some embodiments, a Claudin18.2-binding moiety comprises (i) a VH comprising SEQ ID NO: 255; and/or (ii) a VL comprising SEQ ID NO: 256.

In some embodiments, a Claudin18.2-binding moiety comprises (i) a VH comprising an amino acid sequence having at least 80%, at least 85%, at least 90%, at least 95%, at least 98% sequence identity to SEQ ID NO: 257; and/or (ii) a VL comprising an amino acid sequence having at least 80%, at least 85%, at least 90%, at least 95%, at least 98% sequence identity to SEQ ID NO: 258. In some embodiments, a Claudin18.2-binding moiety comprises (i) a VH comprising SEQ ID NO: 257; and/or (ii) a VL comprising SEQ ID NO: 258.

In some embodiments, a Claudin18.2-binding moiety comprises (i) a VH comprising an amino acid sequence having at least 80%, at least 85%, at least 90%, at least 95%, at least 98% sequence identity to SEQ ID NO: 259; and/or (ii) a VL comprising an amino acid sequence having at least 80%, at least 85%, at least 90%, at least 95%, at least 98% sequence identity to SEQ ID NO: 260. In some embodiments, a Claudin18.2-binding moiety comprises (i) a VH comprising SEQ ID NO: 259; and/or (ii) a VL comprising SEQ ID NO: 260.

In some embodiments, a Claudin18.2-binding moiety comprises (i) a VH comprising an amino acid sequence having at least 80%, at least 85%, at least 90%, at least 95%, at least 98% sequence identity to SEQ ID NO: 261; and/or (ii) a VL comprising an amino acid sequence having at least 80%, at least 85%, at least 90%, at least 95%, at least 98% sequence identity to SEQ ID NO: 262. In some embodiments, a Claudin18.2-binding moiety comprises (i) a VH comprising SEQ ID NO: 261; and/or (ii) a VL comprising SEQ ID NO: 262.

In some embodiments, a Claudin18.2-binding moiety comprises (i) a VH comprising an amino acid sequence having at least 80%, at least 85%, at least 90%, at least 95%, at least 98% sequence identity to SEQ ID NO: 263; and/or (ii) a VL comprising an amino acid sequence having at least 80%, at least 85%, at least 90%, at least 95%, at least 98% sequence identity to SEQ ID NO: 264. In some embodiments, a Claudin18.2-binding moiety comprises (i) a VH comprising SEQ ID NO: 263; and/or (ii) a VL comprising SEQ ID NO: 264.

In some embodiments, a Claudin18.2-binding moiety comprises (i) a VH comprising an amino acid sequence having at least 80%, at least 85%, at least 90%, at least 95%, at least 98% sequence identity to SEQ ID NO: 265; and/or (ii) a VL comprising an amino acid sequence having at least 80%, at least 85%, at least 90%, at least 95%, at least 98% sequence identity to SEQ ID NO: 266. In some embodiments, a Claudin18.2-binding moiety comprises (i) a VH comprising SEQ ID NO: 265; and/or (ii) a VL comprising SEQ ID NO: 266.

In some embodiments, a Claudin18.2-binding moiety comprises (i) a VH comprising an amino acid sequence having at least 80%, at least 85%, at least 90%, at least 95%, at least 98% sequence identity to SEQ ID NO: 267; and/or (ii) a VL comprising an amino acid sequence having at least 80%, at least 85%, at least 90%, at least 95%, at least 98% sequence identity to SEQ ID NO: 268. In some embodiments, a Claudin18.2-binding moiety comprises (i) a VH comprising SEQ ID NO: 267; and/or (ii) a VL comprising SEQ ID NO: 268.

In some embodiments, a Claudin18.2-binding moiety comprises (i) a VH comprising an amino acid sequence having at least 80%, at least 85%, at least 90%, at least 95%, at least 98% sequence identity to SEQ ID NO: 269; and/or (ii) a VL comprising an amino acid sequence having at least 80%, at least 85%, at least 90%, at least 95%, at least 98% sequence identity to SEQ ID NO: 270. In some embodiments, a Claudin18.2-binding moiety comprises (i) a VH comprising SEQ ID NO: 269; and/or (ii) a VL comprising SEQ ID NO: 270.

In some embodiments, a Claudin18.2-binding moiety comprises (i) a VH comprising an amino acid sequence having at least 80%, at least 85%, at least 90%, at least 95%, at least 98% sequence identity to SEQ ID NO: 271; and/or (ii) a VL comprising an amino acid sequence having at least 80%, at least 85%, at least 90%, at least 95%, at least 98% sequence identity to SEQ ID NO: 272. In some embodiments, a Claudin18.2-binding moiety comprises (i) a VH comprising SEQ ID NO: 271; and/or (ii) a VL comprising SEQ ID NO: 272.

In some embodiments, a Claudin18.2-binding moiety comprises (i) a VH comprising an amino acid sequence having at least 80%, at least 85%, at least 90%, at least 95%, at least 98% sequence identity to SEQ ID NO: 273; and/or (ii) a VL comprising an amino acid sequence having at least 80%, at least 85%, at least 90%, at least 95%, at least 98% sequence identity to SEQ ID NO: 274. In some embodiments, a Claudin18.2-binding moiety comprises (i) a VH comprising SEQ ID NO: 273; and/or (ii) a VL comprising SEQ ID NO: 274.

In some embodiments, a Claudin18.2-binding moiety comprises (i) a VH comprising an amino acid sequence having at least 80%, at least 85%, at least 90%, at least 95%, at least 98% sequence identity to SEQ ID NO: 275; and/or (ii) a VL comprising an amino acid sequence having at least 80%, at least 85%, at least 90%, at least 95%, at least 98% sequence identity to SEQ ID NO: 276. In some embodiments, a Claudin18.2-binding moiety comprises (i) a VH comprising SEQ ID NO: 275; and/or (ii) a VL comprising SEQ ID NO: 276.

In some embodiments, a Claudin18.2-binding moiety comprises (i) a VH comprising an amino acid sequence having at least 80%, at least 85%, at least 90%, at least 95%, at least 98% sequence identity to SEQ ID NO: 277; and/or (ii) a VL comprising an amino acid sequence having at least 80%, at least 85%, at least 90%, at least 95%, at least 98% sequence identity to SEQ ID NO: 278. In some embodiments, a Claudin18.2-binding moiety comprises (i) a VH comprising SEQ ID NO: 277; and/or (ii) a VL comprising SEQ ID NO: 278.

In some embodiments, a Claudin18.2-binding moiety comprises (i) a VH comprising an amino acid sequence having at least 80%, at least 85%, at least 90%, at least 95%, at least 98% sequence identity to SEQ ID NO: 279; and/or (ii) a VL comprising an amino acid sequence having at least 80%, at least 85%, at least 90%, at least 95%, at least 98% sequence identity to SEQ ID NO: 280. In some embodiments, a Claudin18.2-binding moiety comprises (i) a VH comprising SEQ ID NO: 279; and/or (ii) a VL comprising SEQ ID NO: 280.

In some embodiments, a Claudin18.2-binding moiety comprises (i) a VH comprising an amino acid sequence having at least 80%, at least 85%, at least 90%, at least 95%, at least 98% sequence identity to SEQ ID NO: 281; and/or (ii) a VL comprising an amino acid sequence having at least 80%, at least 85%, at least 90%, at least 95%, at least 98% sequence identity to SEQ ID NO: 282. In some embodiments, a Claudin18.2-binding moiety comprises (i) a VH comprising SEQ ID NO: 281; and/or (ii) a VL comprising SEQ ID NO: 282.

In some embodiments, a Claudin18.2-binding moiety comprises (i) a VH comprising an amino acid sequence having at least 80%, at least 85%, at least 90%, at least 95%, at least 98% sequence identity to SEQ ID NO: 283; and/or (ii) a VL comprising an amino acid sequence having at least 80%, at least 85%, at least 90%, at least 95%, at least 98% sequence identity to SEQ ID NO: 284. In some embodiments, a Claudin18.2-binding moiety comprises (i) a VH comprising SEQ ID NO: 283; and/or (ii) a VL comprising SEQ ID NO: 284.

In some embodiments, a Claudin18.2-binding moiety comprises (i) a VH comprising an amino acid sequence having at least 80%, at least 85%, at least 90%, at least 95%, at least 98% sequence identity to SEQ ID NO: 285; and/or (ii) a VL comprising an amino acid sequence having at least 80%, at least 85%, at least 90%, at least 95%, at least 98% sequence identity to SEQ ID NO: 286. In some embodiments, a Claudin18.2-binding moiety comprises (i) a VH comprising SEQ ID NO: 285; and/or (ii) a VL comprising SEQ ID NO: 286.

In some embodiments, a Claudin18.2-binding moiety comprises (i) a VH comprising an amino acid sequence having at least 80%, at least 85%, at least 90%, at least 95%, at least 98% sequence identity to SEQ ID NO: 287; and/or (ii) a VL comprising an amino acid sequence having at least 80%, at least 85%, at least 90%, at least 95%, at least 98% sequence identity to SEQ ID NO: 288. In some embodiments, a Claudin18.2-binding moiety comprises (i) a VH comprising SEQ ID NO: 287; and/or (ii) a VL comprising SEQ ID NO: 288.

In some embodiments, a Claudin18.2-binding moiety comprises (i) a VH comprising an amino acid sequence having at least 80%, at least 85%, at least 90%, at least 95%, at least 98% sequence identity to SEQ ID NO: 289; and/or (ii) a VL comprising an amino acid sequence having at least 80%, at least 85%, at least 90%, at least 95%, at least 98% sequence identity to SEQ ID NO: 290. In some embodiments, a Claudin18.2-binding moiety comprises (i) a VH comprising SEQ ID NO: 289; and/or (ii) a VL comprising SEQ ID NO: 290.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 337-345; and/or (ii) a VL comprising an amino acid sequence having at least 80%, at least 85%, at least 90%, at least 95%, at least 98% sequence identity to either of SEQ ID NO: 346 and 347. In some embodiments, a Claudin18.2-binding moiety comprises (i) a VH comprising any one of SEQ ID NOs: 337-345; and/or (ii) a VL comprising either of SEQ ID NO: 346 and 347.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 348-352; and/or (ii) a VL comprising an amino acid sequence having at least 80%, at least 85%, at least 90%, at least 95%, at least 98% sequence identity to either of SEQ ID NOs: 353 and 354. In some embodiments, a Claudin18.2-binding moiety comprises (i) a VH comprising any one of SEQ ID NOs: 348-352; and/or (ii) a VL comprising either of SEQ ID NOs: 353 and 354.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 355-362; and/or (ii) a VL comprising an amino acid sequence having at least 80%, at least 85%, at least 90%, at least 95%, at least 98% sequence identity to either of SEQ ID NOs: 363 and 364. In some embodiments, a Claudin18.2-binding moiety comprises (i) a VH comprising any one of SEQ ID NOs: 355-362; and/or (ii) a VL comprising either of SEQ ID NOs: 363 and 364.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 365-369; and/or (ii) a VL comprising an amino acid sequence having at least 80%, at least 85%, at least 90%, at least 95%, at least 98% sequence identity to either of SEQ ID NOs: 370 and 371. In some embodiments, a Claudin18.2-binding moiety comprises (i) a VH comprising any one of SEQ ID NOs: 365-369; and/or (ii) a VL comprising either of SEQ ID NOs: 370 and 371.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 372-374; and/or (ii) a VL comprising an amino acid sequence having at least 80%, at least 85%, at least 90%, at least 95%, at least 98% sequence identity to any one of SEQ ID NOs: 375-377. In some embodiments, a Claudin18.2-binding moiety comprises (i) a VH comprising any one of SEQ ID NOs: 372-374; and/or (ii) a VL comprising any one of SEQ ID NOs: 375-377.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 378-380; and/or (ii) a VL comprising an amino acid sequence having at least 80%, at least 85%, at least 90%, at least 95%, at least 98% sequence identity to either of SEQ ID NOs: 381 and 382. In some embodiments, a Claudin18.2-binding moiety comprises (i) a VH comprising any one of SEQ ID NOs: 378-380; and/or (ii) a VL comprising either of SEQ ID NOs: 381 and 382.

In some embodiments, a Claudin18.2-binding moiety comprises (i) a VH comprising an amino acid sequence having at least 80%, at least 85%, at least 90%, at least 95%, at least 98% sequence identity to any one of SEQ ID NOs: 383-385; and/or (ii) a VL comprising an amino acid sequence having at least 80%, at least 85%, at least 90%, at least 95%, at least 98% sequence identity to either of SEQ ID NOs: 386 and 387. In some embodiments, a Claudin18.2-binding moiety comprises (i) a VH comprising any one of SEQ ID NOs: 383-385; and/or (ii) a VL comprising either of SEQ ID NOs: 386 and 387.

In some embodiments, a Claudin18.2-binding moiety comprises (i) a VH comprising an amino acid sequence having at least 80%, at least 85%, at least 90%, at least 95%, at least 98% sequence identity to any one of odd numbered SEQ ID NOs: 495-680; and/or (ii) a VL comprising an amino acid sequence having at least 80%, at least 85%, at least 90%, at least 95%, at least 98% sequence identity to one of even numbered SEQ ID NOs: 495-680 that matches the odd numbered SEQ ID NOs: 495-680 as shown in Table 1 and 2. In some embodiments, a Claudin18.2-binding moiety comprises (i) a VH comprising any one of odd numbered SEQ ID NOs: 495-680; and/or (ii) a VL comprising one of even numbered SEQ ID NOs: 495-680 that matches the odd numbered SEQ ID NOs: 495-680 as shown in Table 1 and 2.

In some embodiments, a binding moiety competes for binding to Claudin18.2 with an anti-Claudin18.2 antibody disclosed herein. In some embodiments, a binding moiety competes for binding to Claudin18.2 with an antibody listed in Tables 1 and 2. In some embodiments, a binding moiety competes for binding to Claudin18.2 with 260G9E8. In some embodiments, a binding moiety competes for binding to Claudin18.2 with 252F1B10. In some embodiments, a binding moiety competes for binding to Claudin18.2 with 257B1G9. In some embodiments, a binding moiety competes for binding to Claudin18.2 with 265E6G2. In some embodiments, a binding moiety competes for binding to Claudin18.2 with 250F4G4. In some embodiments, a binding moiety competes for binding to Claudin18.2 with 262C7C10. In some embodiments, a binding moiety competes for binding to Claudin18.2 with 240F8G2. In some embodiments, a binding moiety competes for binding to Claudin18.2 with 232C5E3. In some embodiments, a binding moiety competes for binding to Claudin18.2 with 252E7C9. In some embodiments, a binding moiety competes for binding to Claudin18.2 with 257G7B9. In some embodiments, a binding moiety competes for binding to Claudin18.2 with 241H10A1. In some embodiments, a binding moiety competes for binding to Claudin18.2 with 273C10E5. In some embodiments, a binding moiety competes for binding to Claudin18.2 with 185F2G12. In some embodiments, a binding moiety competes for binding to Claudin18.2 with 194D3B2. In some embodiments, a binding moiety competes for binding to Claudin18.2 with 207F8G5. In some embodiments, a binding moiety competes for binding to Claudin18.2 with 222B6G5. In some embodiments, a binding moiety competes for binding to Claudin18.2 with 182D10F1. In some embodiments, a binding moiety competes for binding to Claudin18.2 with 234B9D4. In some embodiments, a binding moiety competes for binding to Claudin18.2 with 253E4F7. In some embodiments, a binding moiety competes for binding to Claudin18.2 with 198F10B8. In some embodiments, a binding moiety competes for binding to Claudin 18.2 with 213B10A4. In some embodiments, a binding moiety competes for binding to Claudin18.2 with 370E2B12C3. In some embodiments, a binding moiety competes for binding to Claudin18.2 with 237D2A4. In some embodiments, a binding moiety competes for binding to Claudin18.2 with 203A6C9. In some embodiments, a binding moiety competes for binding to Claudin18.2 with 201F4H6. In some embodiments, a binding moiety competes for binding to Claudin18.2 with 429H6C5. In some embodiments, a binding moiety competes for binding to Claudin18.2 with 407D8G1. In some embodiments, a binding moiety competes for binding to Claudin18.2 with 419B5G9. In some embodiments, a binding moiety competes for binding to Claudin18.2 with 393C2C5. In some embodiments, a binding moiety competes for binding to Claudin18.2 with 412B6E4. In some embodiments, a binding moiety competes for binding to Claudin18.2 with 414A5F7. In some embodiments, a binding moiety competes for binding to Claudin18.2 with 418D2F9. In some embodiments, a binding moiety competes for binding to Claudin18.2 with 410H6H3. In some embodiments, a binding moiety competes for binding to Claudin18.2 with 59B6C4. In some embodiments, a binding moiety competes for binding to Claudin18.2 with 246B5F2. In some embodiments, a binding moiety competes for binding to Claudin18.2 with 418G6A5. In some embodiments, a binding moiety competes for binding to Claudin18.2 with 417A6F11. In some embodiments, a binding moiety competes for binding to Claudin18.2 with 28C5B1. In some embodiments, a binding moiety competes for binding to Claudin18.2 with 35E8D2. In some embodiments, a binding moiety competes for binding to Claudin18.2 with 61H12G10. In some embodiments, a binding moiety competes for binding to Claudin18.2 with 69D5C1. In some embodiments, a binding moiety competes for binding to Claudin18.2 with 181C7B2. In some embodiments, a binding moiety competes for binding to Claudin18.2 with 196A12B10. In some embodiments, a binding moiety competes for binding to Claudin18.2 with 232D7C8. In some embodiments, a binding moiety competes for binding to Claudin18.2 with 233D5E5. In some embodiments, a binding moiety competes for binding to Claudin18.2 with 232F1E4. In some embodiments, a binding moiety competes for binding to Claudin18.2 with 231H4G11. In some embodiments, a binding moiety competes for binding to Claudin18.2 with 226A4B5. In some embodiments, a binding moiety competes for binding to Claudin18.2 with 235A10C9. In some embodiments, a binding moiety competes for binding to Claudin18.2 with 239H12G9. In some embodiments, a binding moiety competes for binding to Claudin18.2 with 248E6A7. In some embodiments, a binding moiety competes for binding to Claudin18.2 with 254A8D5. In some embodiments, a binding moiety competes for binding to Claudin18.2 with 259C6F4. In some embodiments, a binding moiety competes for binding to Claudin18.2 with 280F3B6. In some embodiments, a binding moiety competes for the binding to Claudin 18.2 with any one of the other anti-Claudin 18.2 antibodies described herein, including mouse, chimeric and humanized antibodies.

The present disclosure further contemplates additional variants and equivalents that are substantially homologous to the recombinant, monoclonal, chimeric, humanized, and human antibodies, or antibody fragments thereof, described herein. In some embodiments, it is desirable to improve the binding affinity of the antibody. In some embodiments, it is desirable to modulate biological properties of the antibody, including but not limited to, specificity, thermostability, expression level, effector function(s), glycosylation, immunogenicity, and/or solubility. Those skilled in the art will appreciate that amino acid changes may alter post-translational processes of an antibody, such as changing the number or position of glycosylation sites or altering membrane anchoring characteristics.

Variations may be a substitution, deletion, or insertion of one or more nucleotides encoding the antibody or polypeptide that results in a change in the amino acid sequence as compared with the native antibody or polypeptide sequence. In some embodiments, amino acid substitutions are the result of replacing one amino acid with another amino acid having similar structural and/or chemical properties, such as the replacement of a leucine with a serine, e.g., conservative amino acid replacements. Insertions or deletions can be in the range of about 1 to 5 amino acids. In some embodiments, the substitution, deletion, or insertion includes (epsilon receptors), IgA (alpha receptors) and IgM (mu receptors). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell cytotoxicity or ADCC), release of inflammatory mediators, placental transfer, and control of immunoglobulin production.

In some embodiments, a Claudin18.2-binding moiety comprises described herein comprises an antibody in which at least one or more of the constant regions has been modified or deleted. In some embodiments, the antibodies comprise modifications to one or more of the three heavy chain constant regions (CH1, CH2 or CH3) and/or to the light chain constant region (CL). In some embodiments, the heavy chain constant region of the modified antibodies comprises at least one human constant region. In some embodiments, the heavy chain constant region of the modified antibodies comprises more than one human constant region. In some embodiments, modifications to the constant region comprise additions, deletions, or substitutions of one or more amino acids in one or more regions. In some embodiments, one or more regions are partially or entirely deleted from the constant regions of the modified antibodies. In some embodiments, the entire CH2 domain has been removed from an antibody (ΔCH2 constructs). In some embodiments, a deleted constant region is replaced by a short amino acid spacer that provides some of the molecular flexibility typically imparted by the absent constant region. In some embodiments, a modified antibody comprises a CH3 domain directly fused to the hinge region of the antibody. In some embodiments, a modified antibody comprises a peptide spacer inserted between the hinge region and modified CH2 and/or CH3 domains.

It is known in the art that the constant region(s) of an antibody mediates several effector functions and these effector functions can vary depending on the isotype of the antibody. For example, binding of the C1 component of complement to the Fc region of IgG or IgM antibodies (bound to antigen) activates the complement system. Activation of complement is important in the opsonization and lysis of cell pathogens. The activation of complement also stimulates the inflammatory response and can be involved in autoimmune hypersensitivity. In addition, the Fc region of an antibody can bind a cell expressing a Fc receptor (FcR). There are a number of Fc receptors which are specific for different classes of antibody, including IgG (gamma receptors), IgE (epsilon receptors), IgA (alpha receptors) and IgM (mu receptors). Binding of antibody to Fc receptors on cell surfaces triggers a number of important and diverse biological responses including engulfment and destruction of antibody-coated particles, clearance of immune complexes, lysis of antibody-coated target cells by killer cells (called antibody-dependent cell cytotoxicity or ADCC), release of inflammatory mediators, placental transfer, and control of immunoglobulin production.

In some embodiments, a Claudin18.2-binding moiety comprises a Fc region. The amino acid sequences of the Fc region of human IgG1, IgG2, IgG3, and IgG4 are known to those of ordinary skill in the art. In some cases, Fc regions with amino acid variations have been identified in native antibodies. In some embodiments, the modified antibodies (e.g., modified Fc region) provide for altered effector functions that, in turn, affect the biological profile of the antibody. For example, in some embodiments, the deletion or inactivation (through point mutations or other means) of a constant region reduces Fc receptor binding of the modified antibody as it circulates. In some embodiments, the constant region modifications increase the serum half-life of the antibody. In some embodiments, the constant region modifications reduce the serum half-life of the antibody. In some embodiments, the constant region modifications decrease or remove ADCC and/or complement dependent cytotoxicity (CDC) of the antibody. In some embodiments, specific amino acid substitutions in a human IgG1 Fc region with corresponding IgG2 or IgG4 residues reduce effector functions (e.g., ADCC and CDC) in the modified antibody. In some embodiments, an antibody does not have one or more effector functions (e.g., "effectorless" antibodies). In some embodiments, the antibody has no ADCC activity and/or no CDC activity. In some embodiments, the antibody does not bind an Fc receptor and/or complement factors. In some embodiments, the antibody has no effector function(s). In some embodiments, the constant region modifications increase or enhance ADCC and/or CDC of the antibody. In some embodiments, the constant region is modified to eliminate disulfide linkages or oligosaccharide moieties. In some embodiments, the constant region is modified to add/substitute one or more amino acids to provide one or more cytotoxin, oligosaccharide, or carbohydrate attachment sites. In some embodiments, a Claudin18.2-binding moiety comprises a variant Fc region that is engineered with substitutions at specific amino acid positions as compared to a native Fc region. In some embodiments, the Fc region is fused via a hinge. The hinge can be an IgG1 hinge, an IgG2 hinge, or an IgG3 hinge.

In some embodiments, variants can include addition of amino acid residues at the amino- and/or carboxyl-terminal end of the antibody or polypeptide. The length of additional amino acids residues may range from one residue to a hundred or more residues. In some embodiments, a variant comprises an N-terminal methionyl residue. In some embodiments, the variant comprises an additional polypeptide/protein (e.g., Fc region) to create a fusion protein. In some embodiments, a variant is engineered to be detectable and may comprise a detectable label and/or protein (e.g., a fluorescent tag or an enzyme).

The variant antibodies or polypeptides described herein can be generated using methods known in the art, including but not limited to, site-directed mutagenesis, alanine scanning mutagenesis, and PCR mutagenesis.

In some embodiments, a variant of a Claudin18.2-binding moiety disclosed herein can retain the ability to recognize a target (e.g., Claudin18.2) to a similar extent, the same extent, or to a higher extent, as the parent binding moiety. In some embodiments, the variant can be at least about 80%, about 85%, about 90%, about 91%, about 92%, about 93%, about 94%, about 95%, about 96%, about 97%, about 98%, about 99% or more identical in amino acid sequence to the parent binding moiety. In some embodiments, the variant can have an amino acid sequence that is at least about 80%, about 85%, about 90%, about 91%, about 92%, about 93%, about 94%, about 95%, about 96%, about 97%, about 98%, about 99% or more identical to the antibodies disclosed herein.

In certain embodiments, a variant of a Claudin18.2-binding moiety comprises the amino acid sequence of the parent a Claudin18.2-binding moiety with one or more conservative amino acid substitutions. Conservative amino acid substitutions are known in the art, and include amino acid substitutions in which one amino acid having certain physical and/or chemical properties is exchanged for another amino acid that has the same or similar chemical or physical properties.

In some embodiments, a variant of a Claudin18.2-binding moiety comprises the amino acid sequence of the parent binding moiety with one or more non-conservative amino acid substitutions. In some embodiments, a variant of a Claudin18.2-binding moiety comprises the amino acid sequence of the parent binding moiety with one or more non-conservative amino acid substitution, wherein the one or more non-conservative amino acid substitutions do not interfere with or inhibit one or more biological activities of the variant (e.g., Claudin18.2 binding). In certain embodiments, the one or more conservative amino acid substitutions and/or the one or more non-conservative amino acid substitutions can enhance a biological activity of the variant, such that the biological activity of the functional variant is increased as compared to the parent binding moiety.

In some embodiments, the function variant can have 1, 2, 3, 4, or 5 amino acid substitutions in the CDRs (e.g., VH CDR1, VH CDR2, VH CDR3, VL CDR1, VL CDR2 and VL CDR3) of the binding moiety.

In some embodiments, Claudin18.2-binding moieties described herein are chemically modified naturally or by intervention. In some embodiments, the Claudin18.2-binding moieties are anti-Claudin18.2 antibodies that have been chemically modified by glycosylation, acetylation, pegylation, phosphorylation, amidation, derivatization by known protecting/blocking groups, proteolytic cleavage, and/or linkage to a cellular ligand or other protein. Any of numerous chemical modifications can be carried out by known techniques. The antigen-binding fragments of embodiments of the invention can comprise one or more analogs of an amino acid (including, for example, unnatural amino acids), as well as other modifications known in the art.

In some embodiments, a Claudin18.2-binding moiety (e.g., an antibody) binds Claudin18.2 (e.g., human Claudin18.2) with a dissociation constant ($K_D$) of about 1 µM or less, about 100 nM or less, about 40 nM or less, about 20 nM or less, about 10 nM or less, about 1 nM or less, about 0.1 nM or less, 50 pM or less, 10 pM or less, or 1 pM or less. In some embodiments, a Claudin18.2-binding moiety binds Claudin18.2 (e.g., human Claudin18.2) with a $K_D$ of about 20 nM or less. In some embodiments, a Claudin18.2-binding moiety binds Claudin18.2 (e.g., human Claudin18.2) with a $K_D$ of about 10 nM or less. In some embodiments, a Claudin18.2-binding moiety binds Claudin18.2 (e.g., human Claudin18.2) with a $K_D$ of about 1 nM or less. In some embodiments, a Claudin18.2-binding moiety binds Claudin18.2 (e.g., human Claudin18.2) with a $K_D$ of about 0.5 nM or less. In some embodiments, a Claudin18.2-binding moiety binds Claudin18.2 (e.g., human Claudin18.2) with a $K_D$ of about 0.1 nM or less. In some embodiments, a Claudin18.2-binding moiety binds Claudin18.2 (e.g., human Claudin18.2) with a $K_D$ of about 50 pM or less. In some embodiments, a Claudin18.2-binding moiety binds Claudin18.2 (e.g., human Claudin18.2) with a $K_D$ of about 25 pM or less. In some embodiments, a Claudin18.2-binding moiety binds Claudin18.2 (e.g., human Claudin18.2) with a $K_D$ of about 10 pM or less. In some embodiments, a Claudin18.2-binding moiety binds Claudin18.2 (e.g., human Claudin18.2) with a $K_D$ of about 1 pM or less. In some embodiments, the dissociation constant of the binding agent (e.g., an antibody) for Claudin18.2 is the dissociation constant determined using a Claudin18.2 protein immobilized on a Biacore chip and the binding agent flowed over the chip. In some embodiments, the dissociation constant of the binding agent (e.g., an antibody) for Claudin18.2 is the dissociation constant determined using the binding agent captured by an anti-human IgG antibody on a Biacore chip and soluble Claudin18.2 flowed over the chip.

In some embodiments, a Claudin18.2-binding moiety (e.g., an antibody) binds Claudin18.2 (e.g., human Claudin18.2) with a half maximal effective concentration ($EC_{50}$) of about 1 µM or less, about 100 nM or less, about 40 nM or less, about 20 nM or less, about 10 nM or less, about 1 nM or less, or about 0.1 nM or less. In some embodiments, a Claudin18.2-binding moiety binds to human Claudin18.2 with an $EC_{50}$ of about 1 µM or less, about 100 nM or less, about 40 nM or less, about 20 nM or less, about 10 nM or less, about 1 nM or less, or about 0.1 nM or less. In some embodiments, a Claudin18.2-binding moiety binds human Claudin18.2 with an $EC_{50}$ of about 40 nM or less. In some embodiments, a Claudin18.2-binding moiety binds human Claudin18.2 with an $EC_{50}$ of about 20 nM or less. In some embodiments, a Claudin18.2-binding moiety binds human Claudin18.2 with an $EC_{50}$ of about 10 nM or less. In some embodiments, a Claudin18.2-binding moiety binds human Claudin18.2 with an $EC_{50}$ of about 1 nM or less. In some embodiments, a Claudin18.2-binding moiety binds human Claudin18.2 with an $EC_{50}$ of about 0.1 nM or less.

In some embodiments, provided herein are polynucleotides comprising polynucleotides encoding that encode a polypeptide (i.e., a Claudin18.2-binding moiety) described herein. The term "polynucleotides that encode a polypeptide" encompasses a polynucleotide which includes only coding sequences for the polypeptide as well as a polynucleotide which includes additional coding and/or non-coding sequences. The polynucleotides of the disclosure can be in the form of RNA or in the form of DNA. DNA includes cDNA, genomic DNA, and synthetic DNA; and can be double-stranded or single-stranded, and if single stranded can be the coding strand or non-coding (anti-sense) strand.

In some embodiments, the polynucleotide comprises a polynucleotide (e.g., a nucleotide sequence) encoding a polypeptide comprising an amino acid sequence selected from SEQ ID NOs: 1-68, 251-290, 337-387 and 495-680.

The present disclosure also provides variants of the polynucleotides described herein, wherein the variant encodes, for example, fragments, analogs, and/or derivatives of a Claudin18.2-binding moiety described herein. In some embodiments, the present disclosure provides a polynucleotide comprising a polynucleotide having a nucleotide sequence at least about 80% identical, at least about 85% identical, at least about 90% identical, at least about 95% identical, at least about 96% identical, at least about 97% identical, at least about 98% identical, or at least about 99% identical to a polynucleotide sequence encoding a polypeptide described herein.

As used herein, the phrase "a polynucleotide having a nucleotide sequence at least about 95% identical to a polynucleotide sequence" means that the nucleotide sequence of the polynucleotide is identical to a reference sequence except that the polynucleotide sequence can include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence can be deleted or substituted with another nucleotide, or a number of nucleotides up to 5% of the total nucleotides in the reference sequence can be inserted into the reference sequence. These mutations of the reference sequence can occur at the 5' or 3' terminal positions of the reference nucleotide sequence or anywhere between those terminal positions, interspersed either individually among nucleotides in the reference sequence or in one or more contiguous groups within the reference sequence.

The polynucleotide variants can contain alterations in the coding regions, non-coding regions, or both. In some embodiments, a polynucleotide variant contains alterations which produce silent substitutions, additions, or deletions, but does not alter the properties or activities of the encoded polypeptide. In some embodiments, a polynucleotide variant comprises silent substitutions that results in no change to the amino acid sequence of the polypeptide (due to the degeneracy of the genetic code). Polynucleotide variants can be produced for a variety of reasons, for example, to optimize codon expression for a particular host (e.g., change codons in the human mRNA to those preferred by a bacterial host such as *E. coli*). In some embodiments, a polynucleotide variant comprises at least one silent mutation in a non-coding or a coding region of the sequence.

In some embodiments, a polynucleotide variant is produced to modulate or alter expression (or expression levels) of the encoded polypeptide. In some embodiments, a polynucleotide variant is produced to increase expression of the encoded polypeptide. In some embodiments, a polynucleotide variant is produced to decrease expression of the encoded polypeptide. In some embodiments, a polynucleotide variant has increased expression of the encoded polypeptide as compared to a parental polynucleotide sequence. In some embodiments, a polynucleotide variant has decreased expression of the encoded polypeptide as compared to a parental polynucleotide sequence.

In some embodiments, a polynucleotide comprises a polynucleotide having a nucleotide sequence at least about 80% identical, at least about 85% identical, at least about 90% identical, at least about 95% identical, at least about 96% identical, at least about 97% identical, at least about 98% identical, or at least about 99% identical to a polynucleotide encoding an amino acid sequence selected from SEQ ID NOs: 1-68, 251-290, 337-387 and 495-680. Also provided is a polynucleotide that comprises a polynucleotide that hybridizes to a polynucleotide encoding an amino acid sequence selected from SEQ ID NOs: 1-68, 251-290, 337-387 and 495-680. In some embodiments, the hybridization is under conditions of high stringency as is known to those skilled in the art.

In some embodiments, a polynucleotide comprises the coding sequence for a polypeptide (e.g., an antibody) fused in the same reading frame to a polynucleotide which aids in expression and secretion of a polypeptide from a host cell (e.g., a leader sequence which functions as a secretory sequence for controlling transport of a polypeptide). The polypeptide can have the leader sequence cleaved by the host cell to form a "mature" form of the polypeptide.

In some embodiments, a polynucleotide comprises the coding sequence for a polypeptide (e.g., an antibody) fused in the same reading frame to a marker or tag sequence. For example, in some embodiments, a marker sequence is a hexa-histidine tag (HIS-tag) that allows for efficient purification of the polypeptide fused to the marker. In some embodiments, a marker sequence is a hemagglutinin (HA) tag derived from the influenza hemagglutinin protein when a mammalian host (e.g., COS-7 cells) is used. In some embodiments, the marker sequence is a FLAG™ tag. In some embodiments, a marker may be used in conjunction with other markers or tags.

In some embodiments, a polynucleotide is isolated. In some embodiments, a polynucleotide is substantially pure.

Vectors and cells comprising the polynucleotides described herein are also provided. In some embodiments, an expression vector comprises a polynucleotide encoding a Claudin18.2-binding moiety described herein. In some embodiments, an expression vector comprises a polynucleotide molecule encoding a polypeptide that is part of a Claudin18.2-binding moiety described herein. In some embodiments, a host cell comprises an expression vector comprising a polynucleotide molecule encoding a Claudin18.2-binding moiety described herein. In some embodiments, a host cell comprises an expression vector comprising a polynucleotide molecule encoding a polypeptide that is part of a Claudin18.2-binding moiety described herein. In some embodiments, a host cell comprises a polynucleotide encoding a Claudin18.2-binding moiety described herein.

The Claudin18.2-binding moieties described herein can be produced by any method known in the art, including chemical synthesis and recombinant expression techniques. The practice of the invention employs, unless otherwise indicated, conventional techniques in molecular biology, microbiology, genetic analysis, recombinant DNA, organic chemistry, biochemistry, PCR, oligonucleotide synthesis and modification, nucleic acid hybridization, and related fields within the skill of the art. These techniques are described in the references cited herein and are fully explained in the literature. See, e.g., Maniatis et al. (1982) *Molecular Cloning: A Laboratory Manual*, Cold Spring Harbor Laboratory Press; Sambrook et al. (1989), *Molecular Cloning: A Laboratory Manual*, Second Edition, Cold Spring Harbor Laboratory Press; Sambrook et al. (2001) Molecular Cloning: A Laboratory Manual, Cold Spring Harbor Laboratory Press, Cold Spring Harbor, N.Y.; Ausubel et al., *Current Protocols in Molecular Biology*, John Wiley & Sons (1987 and annual updates); *Current Protocols in Immunology*, John Wiley & Sons (1987 and annual updates) Gait (ed.) (1984) *Oligonucleotide Synthesis: A Practical Approach*, IRL Press; Eckstein (ed.) (1991) *Oligonucleotides and Analogues: A Practical Approach*, IRL Press; Birren et al. (eds.) (1999) *Genome Analysis: A Laboratory Manual*, Cold Spring Harbor Laboratory Press; Borrebaeck (ed.) (1995) *Antibody Engineering*, Second Edition, Oxford University Press; Lo (ed.) (2006) *Antibody Engineering: Methods and Protocols (Methods in Molecular Biology)*; Vol. 248, Humana Press, Inc; each of which is incorporated herein by reference in its entirety.

The Claudin18.2-binding moieties described herein can be produced and isolated using methods known in the art. Peptides can be synthesized, in whole or in part, using chemical methods (see, e.g., Caruthers (1980). *Nucleic Acids Res. Symp. Ser.* 215; Horn (1980); and Banga, A. K., *Therapeutic Peptides and Proteins, Formulation, Processing and Delivery Systems* (1995) Technomic Publishing Co., Lancaster, Pa.). Peptide synthesis can be performed using various solid-phase techniques (see, e.g., Roberge *Science* 269:202 (1995); Merrifield, *Methods. Enzymol.* 289:3 (1997)) and automated synthesis may be achieved, e.g., using the ABI 431A Peptide Synthesizer (Perkin Elmer) in accordance with the manufacturer's instructions. Peptides can also be synthesized using combinatorial methodologies. Synthetic residues and polypeptides can be synthesized using a variety of procedures and methodologies known in the art (see, e.g., *Organic Syntheses* Collective Volumes, Gilman, et al. (Eds) John Wiley & Sons, Inc., NY). Modified peptides can be produced by chemical modification methods (see, for example, Belousov, *Nucleic Acids Res.* 25:3440 (1997); Frenkel, *Free Radic. Biol. Med.* 19:373 (1995); and Blommers, *Biochemistry* 33:7886 (1994)). Peptide sequence variations, derivatives, substitutions and modifications can also be made using methods such as oligonucleotide-mediated (site-directed) mutagenesis, alanine scanning, and PCR based mutagenesis. Site-directed mutagenesis (Carter et al., *Nucl. Acids Res.*, 13:4331 (1986); Zoller et al., *Nucl. Acids Res.* 10:6487 (1987)), cassette mutagenesis (Wells et al., *Gene* 34:315 (1985)), restriction selection mutagenesis (Wells et al., *Philos. Trans. R. Soc. London SerA* 317:415

(1986)) and other techniques can be performed on cloned DNA to produce invention peptide sequences, variants, fusions and chimeras, and variations, derivatives, substitutions and modifications thereof.

The Claudin18.2-binding moieties described herein that comprise antibody can be prepared using a wide variety of techniques known in the art including the use of hybridoma and recombinant technologies, or a combination thereof. For example, monoclonal antibodies can be produced using hybridoma techniques including those known in the art and taught, for example, in Harlow et al., *Antibodies: A Laboratory Manual*, (Cold Spring Harbor Laboratory Press, 2nd ed. 1988); Hammerling et al., in: *Monoclonal Antibodies and T-Cell Hybridomas* 563 681 (Elsevier, N.Y., 1981), each of which is incorporated herein by reference in its entirety. Other methods of producing the cobinders are also known in the art.

In some embodiments, a recombinant expression vector is used to amplify and express DNA encoding a Claudin18.2-binding moiety. For example, a recombinant expression vector can be a replicable DNA construct that includes synthetic or cDNA-derived DNA fragments encoding a polypeptide chain of a Claudin18.2-binding moiety, such as an anti-Claudin18.2 antibody operatively linked to suitable transcriptional and/or translational regulatory elements derived from mammalian, microbial, viral or insect genes. In some embodiments, a viral vector is used. DNA regions are "operatively linked" when they are functionally related to each other. For example, a promoter is operatively linked to a coding sequence if it controls the transcription of the sequence; or a ribosome binding site is operatively linked to a coding sequence if it is positioned so as to permit translation. In some embodiments, structural elements intended for use in yeast expression systems include a leader sequence enabling extracellular secretion of translated protein by a host cell. In some embodiments, in situations where recombinant protein is expressed without a leader or transport sequence, a polypeptide may include an N-terminal methionine residue.

A wide variety of expression host/vector combinations can be employed. Useful expression vectors for eukaryotic hosts include, for example, vectors comprising expression control sequences from SV40, bovine papilloma virus, adenovirus, and cytomegalovirus. Useful expression vectors for bacterial hosts include known bacterial plasmids, such as plasmids from *E. coli*, including pCR1, pBR322, pMB9 and their derivatives, and wider host range plasmids, such as M13 and other filamentous single-stranded DNA phages.

In some embodiments, a Claudin18.2-binding moiety (e.g., an antibody) of the present disclosure is expressed from one or more vectors. Suitable host cells for expression of a Claudin18.2-binding moiety (e.g., an antibody) or a Claudin18.2 protein or fragment thereof to use as an antigen or immunogen include prokaryotes, yeast cells, insect cells, or higher eukaryotic cells under the control of appropriate promoters. Appropriate cloning and expression vectors for use with bacterial, fungal, yeast, and mammalian cellular hosts, as well as methods of protein production, including antibody production are well-known in the art.

Examples of suitable mammalian host cell lines include, but are not limited to, COS-7 (monkey kidney-derived), L-929 (murine fibroblast-derived), C127 (murine mammary tumor-derived), 3T3 (murine fibroblast-derived), CHO (Chinese hamster ovary-derived), HeLa (human cervical cancer-derived), BHK (hamster kidney fibroblast-derived), HEK-293 (human embryonic kidney-derived) cell lines and variants thereof. Mammalian expression vectors can comprise non-transcribed elements such as an origin of replication, a suitable promoter and enhancer linked to the gene to be expressed, and other 5' or 3' flanking non-transcribed sequences, and 5' or 3' non-translated sequences, such as necessary ribosome binding sites, a polyadenylation site, splice donor and acceptor sites, and transcriptional termination sequences. Expression of recombinant proteins in insect cell culture systems (e.g., baculovirus) also offers a robust method for producing correctly folded and biologically functional proteins. Baculovirus systems for production of heterologous proteins in insect cells are well-known to those of skill in the art Thus, the present disclosure provides cells comprising the Claudin18.2-binding moieties described herein. In some embodiments, the cells produce the Claudin18.2-binding moieties described herein. In some embodiments, the cells produce an antibody. In some embodiments, the cells produce an antibody that specifically binds human Claudin18.2.

In some embodiments, the cells produce the antibody or a variant thereof described herein. In some embodiments, the cells produce chimeric version of the antibody described herein. In some embodiments, the cells produce a humanized version of the antibody described herein. In some embodiments, the cell is a prokaryotic cell (e.g., *E. coli*). In some embodiments, the cell is an eukaryotic cell. In some embodiments, the cell is a mammalian cell. In some embodiments, the cell is a hybridoma cell.

Claudin18.2-binding moieties (e.g., antibodies) of the present disclosure can be analyzed for their physical, chemical and/or biological properties by various methods known in the art. In some embodiments, an anti-Claudin18.2 antibody is tested for its ability to bind Claudin18.2 (e.g., human Claudin18.2 and/or rhesus Claudin18.2). Binding assays include, but are not limited to, SPR (e.g., Biacore), ELISA, and FACS. In addition, antibodies may be evaluated for solubility, stability, thermostability, viscosity, expression levels, expression quality, and/or purification efficiency.

Epitope mapping is a method of identifying the binding site, region, or epitope on a target protein where an antibody (or other binding moiety) binds. A variety of methods are known in the art for mapping epitopes on target proteins. These methods include mutagenesis, including but not limited to, shotgun mutagenesis, site-directed mutagenesis, and alanine scanning; domain or fragment scanning; peptide scanning (e.g., Pepscan technology); display methods (e.g., phage display, microbial display, and ribosome/mRNA display); methods involving proteolysis and mass spectroscopy; and structural determination (e.g., X-ray crystallography and NMR). In some embodiments, Claudin18.2-binding moieties (e.g., antibodies) described herein are characterized by assays including, but not limited to, N-terminal sequencing, amino acid analysis, HPLC, mass spectrometry, ion exchange chromatography, and papain digestion.

In some embodiments, a Claudin18.2-binding moiety comprises conjugates comprising an anti-Claudin18.2 antibody described herein. In some embodiments, an anti-Claudin18.2 antibody is conjugated to a cytotoxic agent or moiety. In some embodiments, an anti-Claudin18.2 antibody is conjugated to a cytotoxic agent to form an ADC (antibody-drug conjugate). In some embodiments, the cytotoxic moiety is a chemotherapeutic agent including, but not limited to, methotrexate, adriamycin/doxorubicin, melphalan, mitomycin C, chlorambucil, duocarmycin, daunorubicin, pyrrolobenzodiazepines (PBDs), or other intercalating agents. In some embodiments, the cytotoxic moiety is a microtubule inhibitor including, but not limited to, auristatins, maytansinoids (e.g., DM1 and DM4), and tubulysins. In some embodiments, the cytotoxic moiety is an enzymatically active toxin of bacterial, fungal, plant, or animal origin, or fragments thereof, including, but not limited to, diphtheria A chain, non-binding active fragments of diphtheria toxin, exotoxin A chain, ricin A chain, abrin A chain, modeccin A chain, alpha-sarcin, *Aleurites fordii* proteins, dianthin proteins, *Phytolaca americana* proteins (PAPI, PAPII, and PAP-S), *Momordica charantia* inhibitor, curcin, crotin, *Sapaonaria officinalis* inhibitor, gelonin, mitogellin, restrictocin, phenomycin, enomycin, and the tricothecenes. In some embodiments, an antibody is conjugated to one or more small molecule toxins, such as calicheamicins, maytansinoids, trichothenes, and CC1065.

In some embodiments, a Claudin18.2-binding moiety (e.g., an antibody) described herein is conjugated to a detectable substance or molecule that allows the agent to be used for diagnosis and/or detection. A detectable substance can include, but is not limited to, enzymes, such as horseradish peroxidase, alkaline phosphatase, beta-galactosidase, and acetylcholinesterase; prosthetic groups, such as biotin and flavine(s); fluorescent materials, such as, umbelliferone, fluorescein, fluorescein isothiocyanate (FITC), rhodamine, tetramethylrhodamine isothiocyanate (TRITC), dichlorotriazinylamine fluorescein, dansyl chloride, cyanine (Cy3), and phycoerythrin; bioluminescent materials, such as luciferase; radioactive materials, such as $^{212}$Bi, $^{14}$C, $^{57}$Co, $^{51}$Cr, $^{67}$Cu, $^{18}$F, $^{68}$Ga, $^{67}$Ga, $^{153}$Gd, $^{159}$Ga, $^{68}$Ge, $^{3}$H, $^{166}$Ho, $^{131}$I, $^{125}$I, $^{123}$I, $^{121}$I, $^{115}$In, $^{113}$In, $^{112}$In, $^{111}$In, $^{140}$La, $^{177}$Lu, $^{54}$Mn, $^{99}$Mo, $^{32}$P, $^{103}$Pd, $^{149}$Pm, $^{142}$Pr, $^{186}$Re, $^{188}$Re, $^{105}$Rh, $^{97}$Ru, $^{35}$S, $^{47}$Sc, $^{75}$Se, $^{153}$Sm, $^{113}$Sn, $^{117}$Sn, $^{85}$Sr, $^{99m}$Tc, $^{201}$Ti, $^{133}$Xe, $^{90}$Y, $^{69}$Yb, $^{175}$Yb, $^{65}$Zn; positron emitting metals; and magnetic metal ions positron emitting metals; and magnetic metal ions.

A Claudin18.2-binding moiety (e.g., an antibody) described herein can be attached to a solid support. Such solid supports include, but are not limited to, glass, cellulose, polyacrylamide, nylon, polystyrene, polyvinyl chloride, or polypropylene. In some embodiments, an immobilized anti-Claudin18.2 antibody is used in an immunoassay. In some embodiments, an immobilized anti-Claudin18.2 antibody is used in purification of the target antigen (e.g., human Claudin18.2 or mouse Claudin18.2).

Chimeric Antigen Receptor

Also provided here are CARs containing an anti-Claudin18.2 scFv described herein. The CARs may contain a signal peptide at the N-terminus of the extracellular antigen binding domain that directs the nascent receptor into the endoplasmic reticulum, and a hinge peptide at the N-terminus of the extracellular antigen binding domain that makes the receptor more available for binding.

The CARs preferably comprises a primary intracellular signaling domain and one or more co-stimulatory signaling domains. The mainly used and most effective primary intracellular signaling domain is CD3-zeta cytoplasmic domain which contains ITAMs, the phosphorylation of which results in T cell activation. The co-stimulatory signaling domain may be derived from the co-stimulatory proteins such as CD28, CD137 and OX40.

In some embodiments, there is provided a CAR targeting Claudin18.2 (also referred herein as "Claudin18.2 CAR") comprising a polypeptide comprising: (a) an extracellular antigen binding domain comprising an anti-Claudin18.2 scFv; (b) a transmembrane domain; and (c) an intracellular signaling domain. In some embodiments, the anti-Claudin18.2 scFv is chimeric, human, or humanized.

In some embodiments, there is provided a Claudin18.2 CAR comprising: (a) an extracellular antigen binding domain comprising an anti-Claudin18.2 scFv; (b) a transmembrane domain; and (c) an intracellular signaling domain, wherein the anti-Claudin18.2 scFv comprises a heavy chain variable region having VH CDR1, CDR2, and CDR3 and a light chain variable region having VL CDR1, CDR2, and CDR3, the VH CDR1, CDR2, CDR3 and the VL CDR1, CDR2, CDR3 comprise amino acid sequences any one of the following: (1) SEQ ID NOs: 69, 89, 117, 136, 143 and 150, respectively; (2) SEQ ID NOs: 69, 90, 117, 137, 143 and 151, respectively; (3) SEQ ID NOs: 69, 90, 117, 137, 143 and 151, respectively; (4) SEQ ID NOs: 70, 90, 117, 136, 143 and 152, respectively; (5) SEQ ID NOs: 69, 91, 117, 137, 143 and 153, respectively; (6) SEQ ID NOs: 71, 92, 117, 136, 143 and 154, respectively; (7) SEQ ID NOs: 71, 92, 117, 136, 143 and 154, respectively; (8) SEQ ID NOs: 72, 93, 117, 136, 143 and 155, respectively; (9) SEQ ID NOs: 69, 94, 118, 136, 143 and 156, respectively; (10) SEQ ID NOs: 73, 95, 117, 137, 143 and 157, respectively; (11) SEQ ID NOs: 74, 96, 119, 136, 144 and 158, respectively; (12) SEQ ID NOs: 74, 96, 119, 136, 144 and 158, respectively; (13) SEQ ID NOs: 70, 97, 120, 138, 145 and 159, respectively; (14) SEQ ID NOs: 70, 98, 120, 136, 145 and 160, respectively; (15) SEQ ID NOs: 75, 99, 120, 139, 146 and 160, respectively; (16) SEQ ID NOs: 75, 100, 120, 139, 146 and 160, respectively; (17) SEQ ID NOs: 70, 90, 121, 137, 145 and 160, respectively; (18) SEQ ID NOs: 76, 101, 122, 140, 147 and 160, respectively; (19) SEQ ID NOs: 76, 101, 123, 136, 147 and 160, respectively; (20) SEQ ID NOs: 70, 201, 120, 137, 145 and 160, respectively; (21) SEQ ID NOs: 70, 202, 120, 136, 145 and 160, respectively; (22) SEQ ID NOs: 77, 102, 124, 141, 148 and 161, respectively; (23) SEQ ID NOs: 78, 103, 125, 136, 143 and 162, respectively; (24) SEQ ID NOs: 79, 104, 126, 136, 149 and 163, respectively; (25) SEQ ID NOs: 78, 105, 127, 142, 143 and 164, respectively; (26) SEQ ID NOs: 80, 106, 128, 136, 143 and 165, respectively; (27) SEQ ID NOs: 81, 107, 129, 136, 143 and 166, respectively; (28) SEQ ID NOs: 82, 108, 130, 136, 143 and 167, respectively; (29) SEQ ID NOs: 80, 109, 130, 141, 143 and 168, respectively; (30) SEQ ID NOs: 83, 110, 130, 136, 143 and 169, respectively; (31) SEQ ID NOs: 80, 109, 131, 141, 143 and 170, respectively; (32) SEQ ID NOs: 80, 111, 132, 136, 143 and 160, respectively; (33) SEQ ID NOs: 84, 112, 132, 136, 143 and 171, respectively; (34) SEQ ID NOs: 85, 113, 133, 136, 143 and 172, respectively; (35) SEQ ID NOs: 86, 114, 134, 136, 143 and 172, respectively; (36) SEQ ID NOs: 87, 115, 131, 136, 143 and 167, respectively; (37) SEQ ID NOs: 88, 116, 135, 136, 143 and 173, respectively; (38) SEQ ID NOs: 203, 211, 225, 233, 241 and 242, respectively; (39) SEQ ID NOs: 204, 212, 226, 136, 143 and 243, respectively; (40) SEQ ID NOs: 205, 213, 227, 234, 143 and 244, respectively; (41) SEQ ID NOs: 206, 214, 131, 235, 143 and 245, respectively; (42) SEQ ID NOs: 207, 215, 228, 136, 143 and 163, respectively; (43) SEQ ID NOs: 208, 216, 229, 236, 143 and 246, respectively; (44) SEQ ID NOs: 69, 90, 230, 237, 143 and 151, respectively; (45) SEQ ID NOs: 69, 217, 117, 137, 143 and 247, respectively; (46) SEQ ID NOs: 209, 218, 231, 136, 143 and 248, respectively; (47) SEQ ID NOs: 72, 219, 117, 238, 143 and 157, respectively; (48) SEQ ID NOs: 75, 220, 120, 137, 145 and 160, respectively; (49) SEQ ID NOs: 69, 221, 117, 136, 143 and 150 respectively; (50) SEQ ID NOs: 72, 222, 118, 136, 143 and 151, respectively; (51) SEQ ID NOs: 69, 223, 118, 239, 143 and 249, respectively; (52) SEQ ID NOs: 210, 224, 232, 240, 143 and 245, respectively; (53) SEQ ID NOs: 72, 217, 118, 136, 143 and 250, respectively; (54) SEQ ID NOs: 69, 90, 117, 137, 143 and 153, respectively; (55) SEQ ID NOs:74, 96, 130, 136, 144 and 158, respectively; (56) SEQ ID NOs: 69, 202, 118, 136, 143, and 455, respectively; (57) SEQ ID NOs: 72, 90, 117, 137, 143, and 153, respectively; (58) SEQ ID NOs: 69, 390, 118, 136, 143, and 249, respectively; (59) SEQ ID NOs: 209, 103, 125, 136, 143, and 162, respectively; (60) SEQ ID NOs: 81, 391, 129, 136, 143, and 162, respectively; (61) SEQ ID NOs: 80, 109, 131, 141, 143, and 167, respectively; (62) SEQ ID NOs: 81, 107, 129, 141, 143, and 166, respectively; (63) SEQ ID NOs: 85, 113, 133, 136, 143, and 172, respectively; (64) SEQ ID NOs: 392, 393, 394, 136, 143, and 163, respectively; (65) SEQ ID NOs: 392, 395, 396, 136, 143, and 163, respectively; (66) SEQ ID NOs: 397, 398, 399, 456, 457, and 250, respectively; (67) SEQ ID NOs: 75, 400, 120, 458, 146, and 160, respectively; (68) SEQ ID NOs: 70, 401, 120, 136, 145, and 160, respectively; (69) SEQ ID NOs: 402, 403, 404, 240, 143, and 244, respectively; (70) SEQ ID NOs: 69, 219, 117, 137, 143, and 157, respectively; (71) SEQ ID NOs: 71, 405, 117, 136, 143, and 459, respectively; (72) SEQ ID NOs: 406, 407, 408, 460, 461, and 462, respectively; (73) SEQ ID NOs: 69, 90, 117, 137, 463, and 464, respectively; (74) SEQ ID NOs: 409, 410, 411, 465, 466, and 162, respectively; (75) SEQ ID NOs: 69, 219, 416, 137, 143, and 157, respectively; (76) SEQ ID NOs: 76, 412, 411, 140, 147, and 160, respectively; (77) SEQ ID NOs: 413, 414, 415, 136, 143, and 467, respectively; (78) SEQ ID NOs: 417, 418, 232, 136, 143, and 244, respectively; (79) SEQ ID NOs: 69, 419, 420, 136, 143, and 468, respectively; (80) SEQ ID NOs: 205, 421, 422, 136, 143, and 469, respectively; (81) SEQ ID NOs: 205, 423, 424, 136, 143, and 154, respectively; (82) SEQ ID NOs: 81, 391, 129, 240, 143, and 166, respectively; (83) SEQ ID NOs: 88, 425, 135, 136, 143, and 470, respectively; (84) SEQ ID NOs: 81, 426, 129, 136, 143, and 166, respectively; (85) SEQ ID NOs: 80, 109, 130, 136, 143, and 471, respectively; (86) SEQ ID NOs: 427, 428, 429, 472, 473, and 474 respectively; (87) SEQ ID NOs: 81, 391, 129, 475, 143, and 166, respectively; (88) SEQ ID NOs: 430, 391, 431, 476, 143, and 166, respectively; (89) SEQ ID NOs: 80, 109, 129, 136, 143, and 477, respectively; (90) SEQ ID NOs: 80, 391, 129, 478, 143, and 166, respectively; (91) SEQ ID NOs: 81, 432, 129, 475, 143, and 166, respectively; (92) SEQ ID NOs: 433, 391, 129, 475, 143, and 166, respectively; (93) SEQ ID NOs: 80, 109, 129, 479, 143, and 163, respectively; (94) SEQ ID NOs: 434, 435, 129, 240, 143, and 166, respectively; (95) SEQ ID NOs: 436, 428, 429, 472, 473, and 474, respectively; (96) SEQ ID NOs: 80, 437, 129, 479, 143, and 163, respectively; (97) SEQ ID NOs: 81, 391, 129, 478, 143, and 166, respectively; (98) SEQ ID NOs: 81, 438, 129, 136, 143, and 166, respectively; (99) SEQ ID NOs: 81, 391, 129, 480, 143, and 481, respectively; (100) SEQ ID NOs: 80, 439, 441, 482, 143, and 483, respectively; (101) SEQ ID NOs: 433, 391, 431, 475, 143, and 166, respectively; (102) SEQ ID NOs: 80, 442, 443, 136, 143, and 160, respectively; (103) SEQ ID NOs: 80, 440, 441, 482, 143, and 484, respectively; (104) SEQ ID NOs: 444, 445, 446, 485, 486, and 487, respectively; (105) SEQ ID NOs: 447, 448, 449, 488, 489, and 490, respectively; (106) SEQ ID NOs: 450, 451, 452, 491, 492, and 493, respectively; (107) SEQ ID NOs: 81, 453, 129, 136, 143, and 166, respectively; or (108) SEQ ID NOs: 69, 89, 454, 136, 143, and 494, respectively; or a variant thereof comprising up to about 5 amino acid substitutions in the CDRs. In some embodiments, the anti-Claudin18.2 scFv is chimeric, human, or humanized.

In some embodiments, there is provided a Claudin18.2 CAR comprising: (a) an extracellular antigen binding domain comprising an anti-Claudin18.2 scFv; (b) a transmembrane domain; and (c) an intracellular signaling domain, wherein the anti-Claudin18.2 scFv comprises a heavy chain variable region having VH CDR1, CDR2, and CDR3 and a light chain variable region having VL CDR1, CDR2, and CDR3, the VH CDR1, CDR2, CDR3 and the VL CDR1, CDR2, CDR3 comprise amino acid sequences of any one of the following: (1) SEQ ID NOs: 69, 89, 117, 136, 143 and 150, respectively; (2) SEQ ID NOs: 69, 90, 117, 137, 143 and 151, respectively; (3) SEQ ID NOs: 69, 90, 117, 137, 143 and 151, respectively; (4) SEQ ID NOs: 70, 90, 117, 136, 143 and 152, respectively; (5) SEQ ID NOs: 69, 91, 117, 137, 143 and 153, respectively; (6) SEQ ID NOs: 71, 92, 117, 136, 143 and 154, respectively; (7) SEQ ID NOs: 71, 92, 117, 136, 143 and 154, respectively; (8) SEQ ID NOs: 72, 93, 117, 136, 143 and 155, respectively; (9) SEQ ID NOs: 69, 94, 118, 136, 143 and 156, respectively; (10) SEQ ID NOs: 73, 95, 117, 137, 143 and 157, respectively; (11) SEQ ID NOs: 74, 96, 119, 136, 144 and 158, respectively; (12) SEQ ID NOs: 74, 96, 119, 136, 144 and 158, respectively; (13) SEQ ID NOs: 70, 97, 120, 138, 145 and 159, respectively; (14) SEQ ID NOs: 70, 98, 120, 136, 145 and 160, respectively; (15) SEQ ID NOs: 75, 99, 120, 139, 146 and 160, respectively; (16) SEQ ID NOs: 75, 100, 120, 139, 146 and 160, respectively; (17) SEQ ID NOs: 70, 90, 121, 137, 145 and 160, respectively; (18) SEQ ID NOs: 76, 101, 122, 140, 147 and 160, respectively; (19) SEQ ID NOs: 76, 101, 123, 136, 147 and 160, respectively; (20) SEQ ID NOs: 70, 201, 120, 137, 145 and 160, respectively; (21) SEQ ID NOs: 70, 202, 120, 136, 145 and 160, respectively; (22) SEQ ID NOs: 77, 102, 124, 141, 148 and 161, respectively; (23) SEQ ID NOs: 78, 103, 125, 136, 143 and 162, respectively; (24) SEQ ID NOs: 79, 104, 126, 136, 149 and 163, respectively; (25) SEQ ID NOs: 78, 105, 127, 142, 143 and 164, respectively; (26) SEQ ID NOs: 80, 106, 128, 136, 143 and 165, respectively; (27) SEQ ID NOs: 81, 107, 129, 136, 143 and 166, respectively; (28) SEQ ID NOs: 82, 108, 130, 136, 143 and 167, respectively; (29) SEQ ID NOs: 80, 109, 130, 141, 143 and 168, respectively; (30) SEQ ID NOs: 83, 110, 130, 136, 143 and 169, respectively; (31) SEQ ID NOs: 80, 109, 131, 141, 143 and 170, respectively; (32) SEQ ID NOs: 80, 111, 132, 136, 143 and 160, respectively; (33) SEQ ID NOs: 84, 112, 132, 136, 143 and 171, respectively; (34) SEQ ID NOs: 85, 113, 133, 136, 143 and 172, respectively; (35) SEQ ID NOs: 86, 114, 134, 136, 143 and 172, respectively; (36) SEQ ID NOs: 87, 115, 131, 136, 143 and 167, respectively; (37) SEQ ID NOs: 88, 116, 135, 136, 143 and 173, respectively; (38) SEQ ID NOs: 203, 211, 225, 233, 241 and 242, respectively; (39) SEQ ID NOs: 204, 212, 226, 136, 143 and 243, respectively; (40) SEQ ID NOs: 205, 213, 227, 234, 143 and 244, respectively; (41) SEQ ID NOs: 206, 214, 131, 235, 143 and 245, respectively; (42) SEQ ID NOs: 207, 215, 228, 136, 143 and 163, respectively; (43) SEQ ID NOs: 208, 216, 229, 236, 143 and 246, respectively; (44) SEQ ID NOs: 69, 90, 230, 237, 143 and 151, respectively; (45) SEQ ID NOs: 69, 217, 117, 137, 143 and 247, respectively; (46) SEQ ID NOs: 209, 218, 231, 136, 143 and 248, respectively; (47) SEQ ID NOs: 72, 219, 117, 238, 143 and 157, respectively; (48) SEQ ID NOs: 75, 220, 120, 137, 145 and 160, respectively; (49) SEQ ID NOs: 69, 221, 117, 136, 143 and 150 respectively; (50) SEQ ID NOs: 72, 222, 118, 136, 143 and 151, respectively; (51) SEQ ID NOs: 69, 223, 118, 239, 143 and 249, respectively; (52) SEQ ID NOs: 210, 224, 232, 240, 143 and 245, respectively; (53) SEQ ID NOs: 72, 217, 118, 136, 143 and 250, respectively; (54) SEQ ID NOs: 69, 90, 117, 137, 143 and 153, respectively; (55) SEQ ID NOs:74, 96, 130, 136, 144 and 158, respectively; (56)

SEQ ID NOs: 69, 202, 118, 136, 143, and 455, respectively; (57) SEQ ID NOs: 72, 90, 117, 137, 143, and 153, respectively; (58) SEQ ID NOs: 69, 390, 118, 136, 143, and 249, respectively; (59) SEQ ID NOs: 209, 103, 125, 136, 143, and 162, respectively; (60) SEQ ID NOs: 81, 391, 129, 136, 143, and 162, respectively; (61) SEQ ID NOs: 80, 109, 131, 141, 143, and 167, respectively; (62) SEQ ID NOs: 81, 107, 129, 141, 143, and 166, respectively; (63) SEQ ID NOs: 85, 113, 133, 136, 143, and 172, respectively; (64) SEQ ID NOs: 392, 393, 394, 136, 143, and 163, respectively; (65) SEQ ID NOs: 392, 395, 396, 136, 143, and 163, respectively; (66) SEQ ID NOs: 397, 398, 399, 456, 457, and 250, respectively; (67) SEQ ID NOs: 75, 400, 120, 458, 146, and 160, respectively; (68) SEQ ID NOs: 70, 401, 120, 136, 145, and 160, respectively; (69) SEQ ID NOs: 402, 403, 404, 240, 143, and 244, respectively; (70) SEQ ID NOs: 69, 219, 117, 137, 143, and 157, respectively; (71) SEQ ID NOs: 71, 405, 117, 136, 143, and 459, respectively; (72) SEQ ID NOs: 406, 407, 408, 460, 461, and 462, respectively; (73) SEQ ID NOs: 69, 90, 117, 137, 463, and 464, respectively; (74) SEQ ID NOs: 409, 410, 411, 465, 466, and 162, respectively; (75) SEQ ID NOs: 69, 219, 416, 137, 143, and 157, respectively; (76) SEQ ID NOs: 76, 412, 411, 140, 147, and 160, respectively; (77) SEQ ID NOs: 413, 414, 415, 136, 143, and 467, respectively; (78) SEQ ID NOs: 417, 418, 232, 136, 143, and 244, respectively; (79) SEQ ID NOs: 69, 419, 420, 136, 143, and 468, respectively; (80) SEQ ID NOs: 205, 421, 422, 136, 143, and 469, respectively; (81) SEQ ID NOs: 205, 423, 424, 136, 143, and 154, respectively; (82) SEQ ID NOs: 81, 391, 129, 240, 143, and 166, respectively; (83) SEQ ID NOs: 88, 425, 135, 136, 143, and 470, respectively; (84) SEQ ID NOs: 81, 426, 129, 136, 143, and 166, respectively; (85) SEQ ID NOs: 80, 109, 130, 136, 143, and 471, respectively; (86) SEQ ID NOs: 427, 428, 429, 472, 473, and 474 respectively; (87) SEQ ID NOs: 81, 391, 129, 475, 143, and 166, respectively; (88) SEQ ID NOs: 430, 391, 431, 476, 143, and 166, respectively; (89) SEQ ID NOs: 80, 109, 129, 136, 143, and 477, respectively; (90) SEQ ID NOs: 80, 391, 129, 478, 143, and 166, respectively; (91) SEQ ID NOs: 81, 432, 129, 475, 143, and 166, respectively; (92) SEQ ID NOs: 433, 391, 129, 475, 143, and 166, respectively; (93) SEQ ID NOs: 80, 109, 129, 479, 143, and 163, respectively; (94) SEQ ID NOs: 434, 435, 129, 240, 143, and 166, respectively; (95) SEQ ID NOs: 436, 428, 429, 472, 473, and 474, respectively; (96) SEQ ID NOs: 80, 437, 129, 479, 143, and 163, respectively; (97) SEQ ID NOs: 81, 391, 129, 478, 143, and 166, respectively; (98) SEQ ID NOs: 81, 438, 129, 136, 143, and 166, respectively; (99) SEQ ID NOs: 81, 391, 129, 480, 143, and 481, respectively; (100) SEQ ID NOs: 80, 439, 441, 482, 143, and 483, respectively; (101) SEQ ID NOs: 433, 391, 431, 475, 143, and 166, respectively; (102) SEQ ID NOs: 80, 442, 443, 136, 143, and 160, respectively; (103) SEQ ID NOs: 80, 440, 441, 482, 143, and 484, respectively; (104) SEQ ID NOs: 444, 445, 446, 485, 486, and 487, respectively; (105) SEQ ID NOs: 447, 448, 449, 488, 489, and 490, respectively; (106) SEQ ID NOs: 450, 451, 452, 491, 492, and 493, respectively; (107) SEQ ID NOs: 81, 453, 129, 136, 143, and 166, respectively; or (108) SEQ ID NOs: 69, 89, 454, 136, 143, and 494, respectively. In some embodiments, the anti-Claudin18.2 scFv is chimeric, human, or humanized.

In some embodiments, there is provided a Claudin18.2 CAR comprising: (a) an extracellular antigen binding domain comprising an anti-Claudin18.2 scFv; (b) a transmembrane domain; and (c) an intracellular signaling domain, wherein the anti-Claudin18.2 scFv comprises a heavy chain variable region VH and a light chain variable region VL, the VH and VL comprise amino acid sequences set forth in: (1) SEQ ID NO: 1 and 2, respectively; (2) SEQ ID NO: 3 and 4, respectively; (3) SEQ ID NO: 5 and 6, respectively; (4) SEQ ID NO: 7 and 8, respectively; (5) SEQ ID NO: 9 and 10, respectively; (6) SEQ ID NO: 11 and 12, respectively; (7) SEQ ID NO: 13 and 14, respectively; (8) SEQ ID NO: 15 and 16, respectively; (9) SEQ ID NOs: 17 and 18, respectively; (10) SEQ ID NOs: 19 and 20, respectively; (11) SEQ ID NOs: 21 and 22, respectively; (12) SEQ ID NOs: 23 and 24, respectively; (13) SEQ ID NOs: 25 and 26, respectively; (14) SEQ ID NOs: 27 and 28, respectively; (15) SEQ ID NOs: 29 and 30, respectively; (16) SEQ ID NOs: 31 and 32, respectively; (17) SEQ ID NOs: 33 and 34, respectively; (18) SEQ ID NOs: 35 and 36, respectively; (19) SEQ ID NOs: 37 and 38, respectively; (20) SEQ ID NOs: 39 and 40, respectively; (21) SEQ ID NOs: 41 and 42, respectively; (22) SEQ ID NOs: 43 and 44, respectively; (23) SEQ ID NOs: 45 and 46, respectively; (24) SEQ ID NOs: 47 and 48, respectively; (25) SEQ ID NOs: 49 and 50, respectively; (26) SEQ ID NOs: 51 and 52, respectively; (27) SEQ ID NOs: 53 and 54, respectively; (28) SEQ ID NOs: 55 and 56, respectively; (29) SEQ ID NOs: 57 and 58, respectively; (30) SEQ ID NOs: 59 and 60, respectively; (31) SEQ ID NOs: 61 and 62, respectively; (32) SEQ ID NOs: 63 and 64, respectively; (33) SEQ ID NOs: 65 and 66, respectively; (34) SEQ ID NOs: 67 and 68, respectively; (35) SEQ ID NOs: 251 and 252, respectively; (36) SEQ ID NOs: 253 and 254, respectively; (37) SEQ ID NOs: 255 and 256, respectively; (38) SEQ ID NOs: 257 and 258, respectively; (39) SEQ ID NOs: 259 and 260, respectively; (40) SEQ ID NOs: 261 and 262, respectively; (41) SEQ ID NOs: 263 and 264, respectively; (42) SEQ ID NOs: 265 and 266, respectively; (43) SEQ ID NOs: 267 and 268, respectively; (44) SEQ ID NOs: 269 and 270, respectively; (45) SEQ ID NOs: 271 and 272, respectively; (46) SEQ ID NOs: 273 and 274, respectively; (47) SEQ ID NOs: 275 and 276, respectively; (48) SEQ ID NOs: 277 and 278, respectively; (49) SEQ ID NOs: 279 and 280, respectively; (50) SEQ ID NOs: 281 and 282, respectively; (51) SEQ ID NOs: 283 and 284, respectively; (52) SEQ ID NOs: 285 and 286, respectively; (53) SEQ ID NOs: 287 and 288, respectively; (54) SEQ ID NOs: 289 and 290, respectively; (55) any one of SEQ ID NOs: 337-345, and SEQ ID NO.: 346, respectively; (56) any one of SEQ ID NOs: 337-345 and SEQ ID NO.: 347, respectively; (57) any one of SEQ ID NOs: 348-352 and SEQ ID Nos: 353, respectively; (58) any one of SEQ ID NOs: 348-352 and SEQ ID Nos: 354, respectively; (59) any one of SEQ ID NOs: 355-362 and SEQ ID NO: 363, respectively; (60) any one of SEQ ID NOs: 355-362 and SEQ ID NO: 364, respectively; (61) any one of SEQ ID NOs: 365-369 and SEQ ID NO: 370, respectively; (62) any one of SEQ ID NOs: 365-369 and SEQ ID NO: 371, respectively; (63) any one of SEQ ID NOs: 372-374 and any one of SEQ ID Nos: 375-377, respectively; (64) any one of SEQ ID NOs: 378-380 and SEQ ID NO: 381, respectively; (65) any one of SEQ ID NOs: 378-380 and SEQ ID NO: 382, respectively; (66) any one of SEQ ID NOs: 383-385 and SEQ ID NO: 386, respectively; (67) any one of SEQ ID NOs: 383-385 and SEQ ID NO: 387, respectively; (68) the amino acid sequences of SEQ ID NOs: 495 and 496, respectively; (69) the amino acid sequences of SEQ ID NOs: 497 and 498, respectively; (70) the amino acid sequences of SEQ ID NOs: 499 and 500, respectively; (71) the amino acid sequences of SEQ ID NOs: 501 and 502, respectively; (72) the amino acid sequences of SEQ ID NOs: 503 and 504, respectively; (73) the amino acid sequences of SEQ ID NOs:

505 and 506, respectively; (74) the amino acid sequences of SEQ ID NOs: 507 and 508, respectively; (75) the amino acid sequences of SEQ ID NOs: 509 and 510, respectively; (76) the amino acid sequences of SEQ ID NOs: 511 and 512, respectively; (77) the amino acid sequences of SEQ ID NOs: 513 and 514, respectively; (78) the amino acid sequences of SEQ ID NOs: 515 and 516, respectively; (79) the amino acid sequences of SEQ ID NOs: 517 and 518, respectively; (80) the amino acid sequences of SEQ ID NOs: 519 and 520, respectively; (81) the amino acid sequences of SEQ ID NOs: 521 and 522, respectively; (82) the amino acid sequences of SEQ ID NOs: 523 and 524, respectively; (83) the amino acid sequences of SEQ ID NOs: 525 and 526, respectively; (84) the amino acid sequences of SEQ ID NOs: 527 and 528, respectively; (85) the amino acid sequences of SEQ ID NOs: 529 and 530, respectively; (86) the amino acid sequences of SEQ ID NOs: 531 and 532, respectively; (87) the amino acid sequences of SEQ ID NOs: 533 and 534, respectively; (88) the amino acid sequences of SEQ ID NOs: 535 and 536, respectively; (89) the amino acid sequences of SEQ ID NOs: 537 and 538, respectively; (90) the amino acid sequences of SEQ ID NOs: 539 and 540, respectively; (91) the amino acid sequences of SEQ ID NOs: 541 and 542, respectively; (92) the amino acid sequences of SEQ ID NOs: 543 and 544, respectively; (93) the amino acid sequences of SEQ ID NOs: 545 and 546, respectively; (94) the amino acid sequences of SEQ ID NOs: 547 and 548, respectively; (95) the amino acid sequences of SEQ ID NOs: 549 and 550, respectively; (96) the amino acid sequences of SEQ ID NOs: 551 and 552, respectively; (97) the amino acid sequences of SEQ ID NOs: 553 and 554, respectively; (98) the amino acid sequences of SEQ ID NOs: 555 and 556, respectively; (99) the amino acid sequences of SEQ ID NOs: 557 and 558, respectively; (100) the amino acid sequences of SEQ ID NOs: 559 and 560, respectively; (101) the amino acid sequences of SEQ ID NOs: 561 and 562, respectively; (102) the amino acid sequences of SEQ ID NOs: 563 and 564, respectively; (103) the amino acid sequences of SEQ ID NOs: 565 and 566, respectively; (104) the amino acid sequences of SEQ ID NOs: 567 and 568, respectively; (105) the amino acid sequences of SEQ ID NOs: 569 and 570, respectively; (106) the amino acid sequences of SEQ ID NOs: 571 and 572, respectively; (107) the amino acid sequences of SEQ ID NOs: 573 and 574, respectively; (108) the amino acid sequences of SEQ ID NOs: 575 and 576, respectively; (109) the amino acid sequences of SEQ ID NOs: 577 and 578, respectively; (110) the amino acid sequences of SEQ ID NOs: 579 and 580, respectively; (111) the amino acid sequences of SEQ ID NOs: 581 and 582, respectively; (112) the amino acid sequences of SEQ ID NOs: 583 and 584, respectively; (113) the amino acid sequences of SEQ ID NOs: 585 and 586, respectively; (114) the amino acid sequences of SEQ ID NOs: 587 and 588, respectively; (115) the amino acid sequences of SEQ ID NOs: 589 and 590, respectively; (116) the amino acid sequences of SEQ ID NOs: 591 and 592, respectively; (117) the amino acid sequences of SEQ ID NOs: 1593 and 594, respectively; (118) the amino acid sequences of SEQ ID NOs: 595 and 596, respectively; (119) the amino acid sequences of SEQ ID NOs: 597 and 598, respectively; (120) the amino acid sequences of SEQ ID NOs: 599 and 600, respectively; (121) the amino acid sequences of SEQ ID NOs: 601 and 602, respectively; (122) the amino acid sequences of SEQ ID NOs: 603 and 604, respectively; (123) the amino acid sequences of SEQ ID NOs: 605 and 606, respectively; (124) the amino acid sequences of SEQ ID NOs: 607 and 608, respectively; (125) the amino acid sequences of SEQ ID NOs: 609 and 610, respectively; (126) the amino acid sequences of SEQ ID NOs: 611 and 612, respectively; (127) the amino acid sequences of SEQ ID NOs: 613 and 614, respectively; (128) the amino acid sequences of SEQ ID NOs: 615 and 616, respectively; (129) the amino acid sequences of SEQ ID NOs: 617 and 618, respectively; (130) the amino acid sequences of SEQ ID NOs: 619 and 620, respectively; (131) the amino acid sequences of SEQ ID NOs: 621 and 622, respectively; (132) the amino acid sequences of SEQ ID NOs: 623 and 624, respectively; (133) the amino acid sequences of SEQ ID NOs: 625 and 626, respectively; (134) the amino acid sequences of SEQ ID NOs: 627 and 628, respectively; (135) the amino acid sequences of SEQ ID NOs: 629 and 630, respectively; (136) the amino acid sequences of SEQ ID NOs: 631 and 632, respectively; (137) the amino acid sequences of SEQ ID NOs: 633 and 634, respectively; (138) the amino acid sequences of SEQ ID NOs: 635 and 636, respectively; (139) the amino acid sequences of SEQ ID NOs: 637 and 638, respectively; (140) the amino acid sequences of SEQ ID NOs: 639 and 640, respectively; (141) the amino acid sequences of SEQ ID NOs: 641 and 642, respectively; (142) the amino acid sequences of SEQ ID NOs: 643 and 644, respectively; (143) the amino acid sequences of SEQ ID NOs: 645 and 646, respectively; (144) the amino acid sequences of SEQ ID NOs: 647 and 648, respectively; (145) the amino acid sequences of SEQ ID NOs: 649 and 650, respectively; (155) the amino acid sequences of SEQ ID NOs: 651 and 652, respectively; (156) the amino acid sequences of SEQ ID NOs: 653 and 654, respectively; (157) the amino acid sequences of SEQ ID NOs: 655 and 656, respectively; (158) the amino acid sequences of SEQ ID NOs: 657 and 658, respectively; (159) the amino acid sequences of SEQ ID NOs: 659 and 660, respectively; (160) the amino acid sequences of SEQ ID NOs: 661 and 662, respectively; (167) the amino acid sequences of SEQ ID NOs: 663 and 664, respectively; (168) the amino acid sequences of SEQ ID NOs: 665 and 666, respectively; (169) the amino acid sequences of SEQ ID NOs: 667 and 668, respectively; (170) the amino acid sequences of SEQ ID NOs: 669 and 670, respectively; (171) the amino acid sequences of SEQ ID NOs: 671 and 672, respectively; (172) the amino acid sequences of SEQ ID NOs: 673 and 674, respectively; (173) the amino acid sequences of SEQ ID NOs: 675 and 676, respectively; (174) the amino acid sequences of SEQ ID NOs:677 and 678, respectively; (175) the amino acid sequences of SEQ ID NOs: 679 and 680, respectively. In some embodiments, the anti-Claudin18.2 scFv is chimeric, human, or humanized.

In some embodiments, there is provided a Claudin18.2 CAR comprising: (a) an extracellular antigen binding domain comprising an anti-Claudin18.2 scFv; (b) a transmembrane domain; and (c) an intracellular signaling domain, wherein the anti-Claudin18.2 scFv comprises a heavy chain variable region VH and a light chain variable region VL, the VH and VL comprise amino acid sequences set forth in: (1) SEQ ID NOs: 251 and 252, respectively; (2) SEQ ID NOs: 253 and 254, respectively; (3) SEQ ID NOs: 67 and 68, respectively; (4) SEQ ID NOs: 255 and 256, respectively; (5) SEQ ID NOs: 257 and 258, respectively; (6) SEQ ID NOs: 43 and 44, respectively; (7) SEQ ID NOs: 27 and 28, respectively; (8) SEQ ID NOs: 13 and 14, respectively; (9) SEQ ID NOs: 9 and 10, respectively; (10) SEQ ID NOs: 3 and 4, respectively; (11) SEQ ID NOs: 35 and 36, respectively; (12) SEQ ID NOs: 15 and 16, respectively; (13) SEQ ID NOs: 1 and 2, respectively; (14) SEQ ID NOs: 17 and 18, respectively; (15) SEQ ID NOs: 21 and 22, respectively; (16) SEQ ID NOs: 37 and 38, respectively; (17) SEQ ID NOs: 41 and 42, respectively; (18) SEQ ID NOs: 259 and 260, respectively; (19) SEQ ID NOs: 25 and 26, respectively; (20) SEQ ID NOs: 31 and 32, respectively; (21) SEQ ID NOs: 23 and 24, respectively; (22) SEQ ID NOs: 261 and 262, respectively; (23) SEQ ID NOs: 263 and 264, respectively; (24) SEQ ID NOs: 29 and 30, respectively; (25) SEQ ID NOs: 265 and 266, respectively; (26) SEQ ID NOs: 267 and 268, respectively; (27) SEQ ID NOs: 269 and 270, respectively; (28) SEQ ID NOs: 271 and 272, respectively; (29) SEQ ID NOs: 273 and 274, respectively; (30) SEQ ID NOs: 275 and 276, respectively; (31) SEQ ID NOs: 277 and 278, respectively; (32) SEQ ID NOs: 279 and 280, respectively; (33) SEQ ID NOs: 281 and 282, respectively; (34) SEQ ID NOs: 283 and 284, respectively; (35) SEQ ID NOs: 285 and 286, respectively; (36) SEQ ID NOs: 287 and 288, respectively; or (37) SEQ ID NOs: 289 and 290, respectively. In some embodiments, the anti-Claudin18.2 scFv is chimeric, human, or humanized.

In some embodiments, the anti-Claudin18.2 scFv may comprise a heavy chain variable region and a light chain variable region connected by a linker. The linker may be a short linker peptide of about 10 to 25 amino acids, rich in glycine as well as serine or threonine, such as one comprising an amino acid sequence of SEQ ID NO: 297. The linker may be connected to the N-terminus of the heavy chain variable region and the C-terminus of the light chain variable region, or vice versa. In some embodiments, the extracellular antigen binding domain may further comprise, at the C-terminus, a hinge domain. In some embodiments, the hinge domain is derived from CD8a. In some embodiments, the hinge domain comprises an amino acid sequence of SEQ ID NO: 292. In some embodiments, the extracellular antigen binding domain may further comprise at its N-terminus a signal peptide. The signal peptide may be derived from a molecule selected from the group consisting of CD8a, GM-CSF receptor a, and IgG1 heavy chain. In some embodiments, the signal peptide is derived from CD8a. In some embodiments, the signal peptide comprises an amino acid sequence of SEQ ID NO: 291. In some embodiments, the transmembrane domain may be derived from a molecule selected from the group consisting of CD8a, CD4, CD28, CD137, CD80, CD86, CD152 and PD1. In some embodiments, the transmembrane domain is derived from CD8a or CD28. In some embodiments, the transmembrane domain comprises an amino acid sequence of SEQ ID NO: 293. In some embodiments, the intracellular signaling domain may comprise a primary intracellular signaling domain and a co-stimulatory signaling domain. The primary intracellular signaling domain may be an immunoreceptor tyrosine-based activation motif (ITAM)-containing domain. In some embodiments, the primary intracellular signaling domain is derived from CD3ζ. In some embodiments, the primary intracellular signaling domain comprises the amino acid sequence of SEQ ID NO: 296. In some embodiments, the co-stimulatory signaling domain is derived from a co-stimulatory molecule selected from the group consisting of CD27, CD28, CD137, OX40, CD30, CD40, CD3, LFA-1, ICOS, CD2, CD7, LIGHT, NKG2C, B7-H3, Ligands of CD83 and combinations thereof. In some embodiments, the co-stimulatory signaling domain comprises a cytoplasmic domain of CD28 and/or a cytoplasmic domain of CD137. In some embodiments, the cytoplasmic domain of CD28 and the cytoplasmic domain of CD137 may comprise amino acid sequences of SEQ ID NO: 294 and SEQ ID NO: 295, respectively.

In some embodiments, there is provided a Claudin18.2 CAR comprising: from N terminus to C-terminus, in turn a signal peptide of SEQ ID NO:291, a light chain variable region and a heavy chain variable region described above for anti-Claudin18.2 scFv connected with a linker of SEQ ID NO: 297, a linker of SEQ ID NO: 298, a hinge of SEQ NO: 292, a CD137 cytoplasmic domain of SEQ ID NO: 294, and a CD3-zeta's cytoplasmic domain of SEQ ID NO: 296.

In some embodiments, there is provided a Claudin18.2 CAR comprising a polypeptide having at least about any one of 85%, 86%, 87%, 88%, 89%, 90%, 91%, 92%, 93%, 94%, 95%, 96%, 97%, 98%, 99% sequence identity to an amino acid sequence selected from the group consisting of SEQ ID NOs: 299-335. In some embodiments, there is provided a Claudin18.2 CAR comprising an amino acid sequence selected from the group consisting of SEQ ID NOs: 299-335.

The amino acid sequence ID numbers of CAR and the corresponding scFv contained therein are summarized below in Table 3.

TABLE 3

Amino Acid Sequence ID Numbers of CAR and corresponding scFv

| CAR Code | CAR | ScFv Heavy chain variable region | ScFv Light chain variable region | Antibody clone ID for HV/LV |
|---|---|---|---|---|
| C182001 | SEQ ID NO: 299 | SEQ ID NO: 251 | SEQ ID NO: 252 | 28C5B1 |
| C182002 | SEQ ID NO: 300 | SEQ ID NO: 253 | SEQ ID NO: 254 | 35E8D2 |
| C182003 | SEQ ID NO: 301 | SEQ ID NO: 67 | SEQ ID NO: 68 | 59B6C4 |
| C182004 | SEQ ID NO: 302 | SEQ ID NO: 255 | SEQ ID NO: 256 | 61H12G10 |
| C182005 | SEQ ID NO: 303 | SEQ ID NO: 257 | SEQ ID NO: 258 | 69D5C1 |
| C182006 | SEQ ID NO: 304 | SEQ ID NO: 43 | SEQ ID NO: 44 | 201F4H6 |
| C182007 | SEQ ID NO: 305 | SEQ ID NO: 27 | SEQ ID NO: 28 | 207F8G5 |
| C182008 | SEQ ID NO: 306 | SEQ ID NO: 13 | SEQ ID NO: 14 | 232C5E3 |
| C182009 | SEQ ID NO: 307 | SEQ ID NO: 9 | SEQ ID NO: 10 | 250F4G4 |

TABLE 3-continued

Amino Acid Sequence ID Numbers of CAR and corresponding scFv

| CAR Code | CAR | ScFv Heavy chain variable region | ScFv Light chain variable region | Antibody clone ID for HV/LV |
|---|---|---|---|---|
| C182010 | SEQ ID NO: 308 | SEQ ID NO: 3 | SEQ ID NO: 4 | 252F1B10 |
| C182011 | SEQ ID NO: 309 | SEQ ID NO: 35 | SEQ ID NO: 36 | 253E4F7 |
| C182012 | SEQ ID NO: 310 | SEQ ID NO: 15 | SEQ ID NO: 16 | 252E7C9 |
| C182013 | SEQ ID NO: 311 | SEQ ID NO: 1 | SEQ ID NO: 2 | 260G9E8 |
| C182014 | SEQ ID NO: 312 | SEQ ID NO: 17 | SEQ ID NO: 18 | 257G7B9 |
| C182015 | SEQ ID NO: 313 | SEQ ID NO: 21 | SEQ ID NO: 22 | 273C10E5 |
| C182016 | SEQ ID NO: 314 | SEQ ID NO: 37 | SEQ ID NO: 38 | 370E2B12C3 |
| C182017 | SEQ ID NO: 315 | SEQ ID NO: 41 | SEQ ID NO: 42 | 203A6C9 |
| C182018 | SEQ ID NO: 316 | SEQ ID NO: 259 | SEQ ID NO: 260 | 181C7B2 |
| C182019 | SEQ ID NO: 317 | SEQ ID NO: 25 | SEQ ID NO: 26 | 194D3B2 |
| C182020 | SEQ ID NO: 318 | SEQ ID NO: 31 | SEQ ID NO: 32 | 182D10F1 |
| C182021 | SEQ ID NO: 319 | SEQ ID NO: 23 | SEQ ID NO: 24 | 185F2G12 |
| C182022 | SEQ ID NO: 320 | SEQ ID NO: 261 | SEQ ID NO: 262 | 196A12B10 |
| C182023 | SEQ ID NO: 321 | SEQ ID NO: 263 | SEQ ID NO: 264 | 198F10B8 |
| C182024 | SEQ ID NO: 322 | SEQ ID NO: 29 | SEQ ID NO: 30 | 222B6G5 |
| C182025 | SEQ ID NO: 323 | SEQ ID NO: 265 | SEQ ID NO: 266 | 213B10A4 |
| C182026 | SEQ ID NO: 324 | SEQ ID NO: 267 | SEQ ID NO: 268 | 232D7C8 |
| C182027 | SEQ ID NO: 325 | SEQ ID NO: 269 | SEQ ID NO: 270 | 233D5E5 |
| C182028 | SEQ ID NO: 326 | SEQ ID NO: 271 | SEQ ID NO: 272 | 232F1E4 |
| C182029 | SEQ ID NO: 327 | SEQ ID NO: 273 | SEQ ID NO: 274 | 231H4G11 |
| C182030 | SEQ ID NO: 328 | SEQ ID NO: 275 | SEQ ID NO: 276 | 226A4B5 |
| C182031 | SEQ ID NO: 329 | SEQ ID NO: 277 | SEQ ID NO: 278 | 235A10C9 |
| C182032 | SEQ ID NO: 330 | SEQ ID NO: 279 | SEQ ID NO: 280 | 239H12G9 |
| C182033 | SEQ ID NO: 331 | SEQ ID NO: 281 | SEQ ID NO: 282 | 240F8G2 |
| C182034 | SEQ ID NO: 332 | SEQ ID NO: 283 | SEQ ID NO: 284 | 248E6A7 |
| C182035 | SEQ ID NO: 333 | SEQ ID NO: 285 | SEQ ID NO: 286 | 254A8D5 |
| C182036 | SEQ ID NO: 334 | SEQ ID NO: 287 | SEQ ID NO: 288 | 259C6F4 |
| C182037 | SEQ ID NO: 335 | SEQ ID NO: 289 | SEQ ID NO: 290 | 280F3B6 |

In some embodiments, there is provided a multivalent CAR targeting Claudin18.2 comprising: (a) an extracellular antigen binding domain comprising a plurality (such as at least about any one of 2, 3, 4 or more) of a Claudin18.2 binding moiety (e.g., an anti-Claudin18.2 scFv); (b) a transmembrane domain; and (c) an intracellular signaling domain. Any of the anti-Claudin18.2 scFvs can be used to construct the multivalent Claudin18.2 CAR.

The CARs may further add factors that enhance T cell expansion, persistence, and anti-tumor activity, such as cytokines, and co-stimulatory ligands.

Also provided are engineered immune cells, comprising any one of the CARs provided herein. In some embodiments, the immune cell is a T cell, an NK cell, a peripheral blood mononuclear cell (PBMC), a hematopoietic stem cell, a pluripotent stem cell, or an embryonic stem cell. In some embodiments, the immune cell is a T cell, such as a cytotoxic T cell, a helper T cell, a natural killer T cell, or a γδT cell. In some embodiments, the engineered immune cell is autologous. In some embodiments, the engineered immune cell is allogenic. In some embodiments, the engineered immune cells are CAR-T cells.

In some embodiments, there is provided an isolated nucleic acid encoding any of the Claudin 18.2 CAR provided herein. In some embodiments, the present application provides vectors for cloning and expressing any one of the Claudin 18.2 CAR described herein. In some embodiments, the vector is suitable for replication and integration in eukaryotic cells, such as mammalian cells. In some embodiments, the vector is a viral vector. Examples of viral vectors include, but are not limited to, adenoviral vectors, adeno-associated virus vectors, lentiviral vector, retroviral vectors, vaccinia vector, herpes simplex viral vector, and derivatives thereof. Viral vector technology is well known in the art and is described, for example, in Sambrook et al. (2001, Molecular Cloning: A Laboratory Manual, Cold Spring Harbor Laboratory, New York), and in other virology and molecular biology manuals. A number of viral based systems have been developed for gene transfer into mammalian cells. For example, retroviruses provide a convenient platform for gene delivery systems. The heterologous nucleic acid can be inserted into a vector and packaged in retroviral particles using techniques known in the art. The recombinant virus can then be isolated and delivered to the engineered mammalian cell in vitro or ex vivo. A number of retroviral systems are known in the art. In some embodiments, adenovirus vectors are used. A number of adenovirus vectors are known in the art. In some embodiments, lentivirus vectors are used. In some embodiments, self-inactivating lentiviral vectors are used. For example, self-inactivating lentiviral vectors carrying chimeric receptors can be packaged with protocols known in the art. The resulting lentiviral vectors can be used to transduce a mammalian cell (such as primary human T cells) using methods known in the art. Vectors derived from retroviruses such as lentivirus are suitable tools to achieve long-term gene transfer, because they allow long-term, stable integration of a transgene and its propagation in progeny cells. Lentiviral vectors also have low immunogenicity, and can transduce non-proliferating cells. In some embodiments, the vector is a non-viral vector. In some embodiments, the vector is a transposon, such as a Sleeping Beauty (SB) transposon system, or a PiggyBac transposon system. In some embodiments, the vector is a polymer-based non-viral vector, including for example, poly (lactic-co-glycolic acid) (PLGA) and poly lactic acid (PLA), poly(ethylene imine) (PEI), and dendrimers. In some embodiments, the vector is a cationic-lipid based non-viral vector, such as cationic liposome, lipid nanoemulsion, and solid lipid nanoparticle (SLN). In some embodiments, the vector is a peptide-based gene non-viral vector, such as poly-L-lysine. Any of the known non-viral vectors suitable for genome editing can be used for introducing the chimeric receptor-encoding nucleic acids to the engineered immune cells. See, for example, Yin H. et al. Nature Rev. Genetics (2014) 15:521-555; Aronovich E L et al. "The Sleeping Beauty transposon system: a non-viral vector for gene therapy". Hum. Mol. Genet. (2011) R1: R14-20; and Zhao S. et al. "PiggyBac transposon vectors: the tools of the human gene editing." Transl. Lung Cancer Res. (2016) 5(1): 120-125, which are incorporated herein by reference. In some embodiments, any one or more of the nucleic acids encoding a chimeric receptor or chimeric receptor system is introduced to the engineered immune cells by a physical method, including, but not limited to electroporation, sonoporation, photoporation, magnetofection, hydroporation.

Compositions

Further provided herein are compositions (e.g., pharmaceutical compositions) comprising a Claudin18.2 binding moiety (e.g., a polypeptide, antibody, or antigen-binding fragment) described herein, a CAR containing an anti-Claudin18.2 scFv described herein, or an engineered immune cell having the CAR described herein. In some embodiments, provided herein are pharmaceutical compositions comprising Claudin18.2 binding moiety described herein, a CAR containing an anti-Claudin18.2 scFv described herein, or an engineered immune cell having the CAR described herein, and a pharmaceutically acceptable carrier or vehicle. In some embodiments, the pharmaceutical compositions are useful in immunotherapy. In some embodiments, the pharmaceutical compositions are useful in immuno-oncology. In some embodiments, the compositions are useful in inhibiting tumor growth. In some embodiments, the pharmaceutical compositions are useful in inhibiting tumor growth in a subject (e.g., a human patient). In some embodiments, the compositions are useful in treating cancer. In some embodiments, the pharmaceutical compositions are useful in treating cancer in a subject (e.g., a human patient).

In some aspects, provided herein is a pharmaceutical formulation comprising a Claudin18.2 binding moiety, a CAR containing an anti-Claudin18.2 scFv or an engineered immune cell having the CAR wherein the formulation is suitable for local administration. In some aspects, local administration comprises intratumoral injection, peritumoral injection, juxtatumoral injection, intralesional injection and/or injection into a tumor draining lymph node, or essentially any tumor-targeted injection where the antitumor agent is expected to leak into primary lymph nodes adjacent to targeted solid tumor.

Formulations are prepared for storage and use by combining a purified Claudin18.2 binding moiety, a CAR containing an anti-Claudin18.2 scFv, or an engineered immune cell having the CAR of the present disclosure with a pharmaceutically acceptable vehicle (e.g., a carrier or excipient). Those of skill in the art generally consider pharmaceutically acceptable carriers, excipients, and/or stabilizers to be inactive ingredients of a formulation or pharmaceutical composition (*Remington: The Science and Practice of Pharmacy,* 22nd Edition, 2012, Pharmaceutical Press, London).

Methods and Uses

The present disclosure also provides methods of use of the Claudin18.2-binding moieties, the CAR containing an anti-Claudin18.2 scFv described herein, the engineered immune cell having the CAR, polynucleotides encoding such Claudin18.2-binding moieties or CARs, recombinant expression vectors comprising such polynucleotides, Claudin18.2-binding moieties or CARs expressing cells or pharmaceutical compositions having such cells disclosed herein in treating Claudin18.2-expressing cancer or tumor. Without being bound by theory, the Claudin18.2-binding moieties disclosed herein (e.g. antibody), the CARs, or the engineered immune cells can specifically target Claudin18.2-expressing cancer cells in vivo, thereby exerting their therapeutic effect of eliminating, lysing and/or killing cancer cells.

In some embodiments, provided herein is a method of treating a Claudin18.2-expressing tumor or cancer in a subject in need thereof, comprising administering to the subject a therapeutically effective amount of a Claudin18.2 binding moiety (e.g. antibody), a CAR containing an anti-Claudin18.2 scFv described herein, or an engineered immune cell having the CAR, or pharmaceutical composition disclosed herein. In some embodiments, the Claudin18.2-expressing cancers or tumors that can be treated are solid tumors. As a non-limiting example, in some embodiments, the Claudin18.2-expressing cancer or tumor can be gastric, esophageal, gastro-esophageal, liver, lung, colorectal, endometrial, breast, pancreatic, testicular, cervical, ovarian, or glioma.

In some embodiments, the Claudin18.2-expressing cancer or tumor can be a gastric cancer or tumor. In some embodiments, the Claudin18.2-expressing cancer or tumor can be a primary gastric adenocarcinoma. In some embodiments, the Claudin18.2-expressing cancer or tumor can be an esophageal cancer or tumor. In some embodiments, the Claudin18.2-expressing cancer or tumor can be a gastro-esophageal cancer or tumor. In some embodiments, the Claudin18.2-expressing cancer or tumor can be any cancer or tumor in which there is expression of Claudin18.2. In some embodiments, the Claudin18.2-expressing cancer or tumor can be any cancer or tumor in which there is ectopic activation of Claudin18.2 (e.g., pancreatic, esophageal, ovarian, and lung tumors). In some embodiments, a Claudin18.2-expressing cancer or tumor can be a primary cancer or tumor (e.g., gastric tumor). In some embodiments, a Claudin18.2-expressing cancer or tumor can be the metastases of a primary cancer or tumor. As a non-limiting example, in some embodiments, the Claudin18.2-expressing cancer or tumor can be localized in lymph node metastases of gastric cancer adenocarcinomas or in distant metastases. In some embodiments, the Claudin18.2-expressing cancer or tumor can be in the ovary (e.g., Krukenberg tumors). In certain embodiments, the Claudin18.2-expressing cancer or tumor is correlated with a histological subtype. As non-limiting examples, in some embodiments, Claudin18.2-expressing cancer or tumor is adenocarcinoma (but not squamous cell cancer) of the esophagus, a mucinous (but not serous) ovarian cancer, or a ductal pancreatic adenocarcinoma (but not pancreatic islet cancer).

In some embodiments, the methods disclosed herein can decrease the number of Claudin18.2 positive tumor cells. In some embodiments, the methods disclosed herein can decrease tumor burden in the subject. In some embodiments, a Claudin18.2-binding moiety disclosed herein can be used to harness the subject's natural defense mechanisms including CDC and ADCC to eliminate malignant or cancer cells.

Methods for monitoring patient response to administration of a pharmaceutical composition disclosed herein are known in the art and can be employed in accordance with methods disclosed herein. In some embodiments, methods known in the art can be employed to monitor the patient for response to administration of a pharmaceutical composition disclosed herein. In some embodiments, methods known in the art can be used to monitor size of lesions, and/or size of lymph nodes.

As a non-limiting example, in some embodiments, contrast-enhanced CT scans can detect and/or monitor lesions and/or lymph nodes in a patient. In some embodiments, administration of a pharmaceutical composition disclosed herein can reduce the size of lesions detected by CT scans in a patient. In some embodiments, administration of a pharmaceutical composition disclosed herein can cause shrinkage of abnormal lymph nodes.

In certain embodiments, the methods provided herein can be used to treat cancer or reduce tumor burden in a subject, wherein the cancer or tumor is Claudin18.2-expressing cancer or tumor. In one embodiment, the methods provided herein are used to treat cancer. It is understood that a method of treating cancer can include any effect that ameliorates a sign or symptom associated with cancer. Such signs or symptoms include, but are not limited to, reducing tumor burden, including inhibiting growth of a tumor, slowing the growth rate of a tumor, reducing the size of a tumor, reducing the number of tumors, eliminating a tumor, all of which can be measured using routine tumor imaging techniques well known in the art. Other signs or symptoms associated with cancer include, but are not limited to, fatigue, pain, weight loss, and other signs or symptoms associated with various cancers. In one non-limiting example, the methods provided herein can reduce tumor burden. Thus, administration of the cells of the invention can reduce the number of tumor cells, reduce tumor size, and/or eradicate the tumor in the subject. The tumor can be a solid tumor. The methods of the invention can also provide for increased or lengthened survival of a subject having cancer. Additionally, methods of the invention can provide for an increased immune response in the subject against the cancer.

In the methods of the invention, a therapeutically effective amount of Claudin18.2 binding moieties (e.g. antibodies), CARs containing anti-Claudin18.2 scFvs, or engineered immune cells having the CARs described herein is administered to a subject in need of cancer treatment. The subject can be a mammal. In some embodiments, the subject is a human. A pharmaceutical composition comprising Claudin18.2 binding moieties (e.g. antibodies), CARs containing anti-Claudin18.2 scFvs, or engineered immune cells having the CARs described herein is administered to a subject to elicit an anti-cancer response, with the objective of palliating the subject's condition. Eliminating cancer or tumor cells in a subject can occur, but any clinical improvement constitutes a benefit. Clinical improvement comprises decreased risk or rate of progression or reduction in pathological consequences of the cancer or tumor.

Another group of suitable subjects can be a subject who has a history of cancer, but has been responsive to another mode of therapy. The prior therapy can have included, but is not restricted to, surgical resection, radiotherapy, and traditional chemotherapy. As a result, these individuals have no clinically measurable tumor. However, they are suspected of being at risk for progression of the disease, either near the original tumor site, or by metastases. This group can be further subdivided into high-risk and low-risk individuals. The subdivision is made on the basis of features observed before or after the initial treatment. These features are known in the clinical arts, and are suitably defined for different types of cancers. Features typical of high-risk subgroups are those in which the tumor has invaded neighboring tissues, or who show involvement of lymph nodes. Optionally, a cell of the invention can be administered for treatment prophylactically to prevent the occurrence of cancer in a subject suspected of having a predisposition to a cancer, for example, based on family history and/or genetic testing.

The subject can have an advanced form of disease, in which case the treatment objective can include mitigation or reversal of disease progression, and/or amelioration of side effects. The subjects can have a history of the condition, for which they have already been treated, in which case the therapeutic objective can be to decrease or delay the risk of recurrence. Additionally, refractory or recurrent malignancies can be treated using the cells or pharmaceutical compositions disclosed herein.

For treatment, the amount administered is an amount effective for producing the desired effect. An effective amount or therapeutically effective amount is an amount sufficient to provide a beneficial or desired clinical result upon treatment. An effective amount can be provided in a single administration or a series of administrations (one or more doses). An effective amount can be provided in a bolus or by continuous perfusion. In terms of treatment, an effective amount is an amount that is sufficient to palliate, ameliorate, stabilize, reverse or slow the progression of the disease, or otherwise reduce the pathological consequences of the disease. The effective amount can be determined by the physician for a particular subject. Several factors are typically taken into account when determining an appropriate dosage to achieve an effective amount. These factors include age, sex and weight of the subject, the condition being treated, the severity of the condition and the form and effective concentration of the cells of the invention being administered.

Combination therapy using agents with different mechanisms of action can result in additive or synergetic effects. Combination therapy can allow for a lower dose of each agent than is used in monotherapy, thereby reducing toxic side effects and/or increasing the therapeutic index of the agent disclosed herein. Combination therapy can decrease the likelihood that resistant cancer cells will develop. In some embodiments, the additional therapy results in an increase in the therapeutic index of the cells or pharmaceutical compositions described herein. In some embodiments, the additional therapy results in a decrease in the toxicity and/or side effects of cells or pharmaceutical compositions described herein.

The additional therapy can be administered prior to, concurrently with, or subsequent to administration of the cells or pharmaceutical compositions described herein. Combined administration can include co-administration, either in a single pharmaceutical formulation or using separate formulations, or consecutive administration in either order but generally within a time period such that all active agents can exert their biological activities simultaneously. A person skilled in the art can readily determine appropriate regimens for administering a Claudin18.2 binding moiety described herein and an additional therapy in combination, including the timing and dosing of an additional agent to be used in a combination therapy, based on the needs of the subject being treated.

It is understood that modifications which do not substantially affect the activity of the various embodiments of this invention are also provided within the definition of the invention provided herein. Accordingly, the following examples are intended to illustrate but not limit the present invention.

EXAMPLES

The examples below are intended to be purely exemplary of the invention and should therefore not be considered to limit the invention in any way. The following examples and detailed description are offered by way of illustration and not by way of limitation.

Example 1. Generation of Mouse Anti-Claudin18.2 Monoclonal Antibodies (mAbs)

Immunization

Balb/c mice were immunized with human Claudin18.2 coding DNA (NCBI, NP_001002026.2)/Claudin18.2 (NCBI, NP_001002026.1) over-expressing CHO cells/first extracellular loop peptides of Claudin18.2/recombinant human Claudin18.2-his proteins (GenScript) (collectively referred to as "antigen") under current animal welfare regulations. The antigen was prepared in PBS solution or formulated as an emulsion with CFA (Complete Freund's adjuvant; for primary immunization) or IFA (incomplete Freund's adjuvant; for boost immunizations). Mice were administered with the antigen(s) intraperitoneally at the abdominal or subcutaneously into the dorsal skin by a gene gun or a syringe. Each animal received 3-5 doses. Blood samples were collected 7 days post each injection to monitor the anti-sera titer using an ELISA-based assay with immobilized Claudin18.2-his proteins or using FACS with Claudin18.2-expressing HEK293 stable cell line until the fusion criteria were met.

Selection of Claudin18.2 Secreting Hybridoma

Three days after the last boost, splenocytes from the mice with good titers were prepared sterilely and fused with sp2/0 cells following a standard hybridoma generation protocol. The fused cells were cultured in 1×HAT (hypoxanthine-aminopterin-thymidine) containing DMEM media, supplemented with 10% FBS, for 7 days. Cell culture supernatants were analyzed for the hybridoma's ability to bind to Claudin18.2-expressing HEK293 stable cell line by FACS, and the hybridoma' binding specificity to the Claudin18.2 target was tested with Claudin18.1-expressing HEK293 stable cell line by FACS. The hybridoma clones showing desired characteristics were subcloned by limiting dilution. The antibodies produced by each unique clone were purified with Protein-A magnetic beads, eluted by 0.5M Sodium-citrate solution (pH3.5), and neutralized with 0.5M Tris-HCl (pH9.0). Then, the proteins were prepared in PBS to determine concentration by spectrophotometry (NanoDrop, Thermo Fisher Scientific). 0.5 mg purified antibodies from each clone were subject to further characterization. Antibody isotypes were determined using Clonotyping System-HRP (SouthernBiotech).

Example 2. In Vitro Characterization of Anti-Claudin18.2 Mouse Antibodies

Claudin18.2 Mouse Antibody Bound to Claudin18.2-his Protein

Figure 1O:
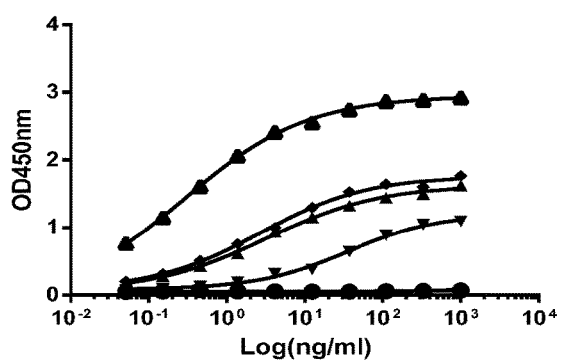

The anti-Claudin18.2 mAbs were analyzed for Claudin18.2-his binding by ELISA, including IgG antibodies and IgM antibodies (such as 246B5F2). Briefly, purified in house made Claudin18.2-his protein in PBS (0.5 μg/ml, 100.0 pH 7.4) was pre-coated onto ELISA plates overnight at 4° C. On the next day, the wells were incubated with serially diluted anti-Claudin18.2 antibodies, three-fold dilution with an initial concentration of 1.0 μg/ml, for 1 hours at 37° C., followed by HRP-conjugated goat anti-mouse IgG (H+L) (1:10000, Rockland Immunochemicals, Inc., 610-103-121) and then TMB (3,3',5,5'-tetramethylbenzidine). Absorbance was read at 450 nm and plotted as FIG. 1A-1O, and data was analyzed with GraphPad Prism v6.02 to determine the $EC_{50}$ values. $EC_{50}$ values of representative antibodies were summarized in Table 4.

TABLE 4

ELISA binding $EC_{50}$ of mouse anti-Claudin18.2 monoclonal antibodies

| Antibody ID | $EC_{50}$ (ng/ml) | Antibody ID | $EC_{50}$ (ng/ml) | Antibody ID | $EC_{50}$ (ng/ml) |
|---|---|---|---|---|---|
| 181C7B2 | 20.58 | 252C10F6 | 1664 | 407H12E6 | 126.1 |
| 182D10F1 | 23.59 | 252E7C9 | 8.69 | 409D1A7 | 7.75 |
| 185F2G12 | 19.31 | 252F1B10 | 7.23 | 409G10G6 | 9.52 |

TABLE 4-continued

ELISA binding EC$_{50}$ of mouse anti-Claudin18.2 monoclonal antibodies

| Antibody ID | EC$_{50}$ (ng/ml) | Antibody ID | EC$_{50}$ (ng/ml) | Antibody ID | EC$_{50}$ (ng/ml) |
|---|---|---|---|---|---|
| 186F7E10 | 10.88 | 253E4F7 | 11.21 | 410A9A9 | 20.75 |
| 186G12H3 | 11.12 | 254A8D5 | 25.23 | 410D9G2 | 23.07 |
| 194A2F7 | 43.76 | 256C3D3 | 13.32 | 410H6H3 | 2.93 |
| 194D3B2 | 16.65 | 257B1G9 | 7.93 | 411A6E3 | 6.74 |
| 196A12B10 | 19.23 | 257F1E11 | 26.22 | 411B4G4 | 9.45 |
| 198F10B8 | 31.51 | 257G7B9 | 9.78 | 411G12G1 | 742.7 |
| 200A4H8 | 10.5 | 257G7F7 | 19.83 | 411G3E10 | 5.43 |
| 201F4H6 | 119.2 | 258D11C4 | 15.27 | 412B6E4 | 6.31 |
| 203A6C9 | 65.38 | 259B4D4 | 19.72 | 413B1C9 | 3.46 |
| 203A6D5 | 27.05 | 259C6F4 | 55.17 | 413C12F8 | 6.82 |
| 207F8G5 | 33.48 | 259C6F7 | 43.92 | 414A5F7 | 8.05 |
| 213B10A4 | 7.79 | 260F8A6 | 15.09 | 414H6G2 | 11.56 |
| 217D9G2 | 27.97 | 260G9E8 | 35.77 | 416F12F3 | 11.53 |
| 219F9B8 | 24.78 | 262C7C10 | 13.68 | 417A6F11 | 42.83 |
| 222B6G5 | 20.13 | 262H9H6 | 13.96 | 418B11D3 | 1 |
| 226A4B5 | 8.13 | 263E9F3 | 11.27 | 418B8B10 | 8.87 |
| 231C11E9 | 41.26 | 265E6G2 | 18.28 | 418D2F9 | 28.87 |
| 231H4G11 | 39.4 | 266B11F7 | 16.82 | 418G6A5 | 26.17 |
| 232C5E3 | 25.88 | 267B2C5 | 11.31 | 419A10D4 | 6.53 |
| 232D7C8 | 30.53 | 267H5F12 | 8.22 | 419A5F3 | 5.51 |
| 232F1E4 | 50.91 | 268D7H9 | 10.32 | 419B5G9 | 23.2 |
| 233D5E5 | 94.3 | 271B1B6 | 10.36 | 420D5H5 | 23.93 |
| 234A10F7 | 26.85 | 273C10E5 | 20.12 | 420F12G8 | 17.62 |
| 234B9D4 | 40.46 | 273F3D4 | 23.31 | 420G10G3 | 11.34 |
| 234C9G5 | 38.66 | 275B2G2 | 27.96 | 420H3H9 | 7.22 |
| 234E1F12 | 104.7 | 275H9A2 | 24.48 | 420H7E6 | 54.51 |
| 235A10C9 | 35.55 | 277F1F8 | 15.78 | 421H4G3 | 7.53 |
| 235C3H11 | 1950 | 279E8B8 | 20.1 | 422E8F9 | 8.73 |
| 235G5E4 | 164.8 | 280F3B6 | 11.97 | 422F4B6 | 149.4 |
| 237D2A4 | 17.46 | 286C7F11 | 15.47 | 423B2B5 | 131.6 |
| 239H12G9 | 19.09 | 292D9C7 | 23.24 | 423C10E1 | 29.71 |
| 240A8E7 | 14.5 | 370E2B12C3 | 15.6 | 424G9G3 | 29.96 |
| 240D6F5 | 7.92 | 391F1G2 | 8.36 | 425B3D5 | 3.7 |
| 240F8G2 | 12.97 | 391H11H3 | 16.16 | 425C6D3 | 11.41 |
| 241H10A1 | 22.05 | 392A11C8 | 20.96 | 426D9F6 | 11.21 |
| 242F5H2 | 19.32 | 392C2F10 | 15.29 | 426H6E11 | 22.4 |
| 242H12D6 | 16.43 | 393C2C5 | 50.43 | 427C7H2 | / |
| 243B4F2 | 12.53 | 394C2G5 | 8.46 | 429H6C5 | / |
| 243F6D2 | 34.62 | 395B3C11 | 4.43 | 430A11H9 | / |
| 244A1B8 | 17.97 | 405G8F11 | 1.99 | 430B3F1 | 15.44 |
| 246B5F2 | 141.5 | 406E1H7 | 9.55 | 430E10B9F1 | 76.97 |
| 246C10H10 | 166.4 | 406F11G8 | 16.01 | 28C5B1 | / |
| 248E6A7 | 9.69 | 406G3C4 | 9.18 | 35E8D2 | 3.191 |
| 248G8E8 | 17.6 | 407A8G10 | 5.54 | 61H12G10 | 35.07 |
| 250F4G1 | 19.64 | 407D8G1 | 8.19 | 69D5C1 | 2.664 |
| 250F4G4 | 18.25 | 407E11H8 | 17.03 | 59B6C9E8 | 7.948 |

Anti-Claudin18.2 Antibody Induced Complement Dependent Cytotoxicity (CDC)

Antibody-dependent cellular cytotoxicity (ADCC) and complement-dependent cytotoxicity (CDC) are the major mechanisms of action for anti-human Claudin18.2 therapeutic antibodies against human gastric or gastro-oesophageal carcinoma.

The anti-Claudin18.2 therapeutic antibodies were functionally tested in a CDC assay. Briefly, CHO-K1 overexpressing human Claudin18.2 (GenScript, Cat. No. M00685) as target cells, were cultured, harvested, and seeded in a 96-well plate at a cell density of $5*10^5$ cells/ml in assay buffer (Fetal Bovine Serum (Gibco, 10099-141) 1%, MEM-α (Gibco, 41061-029) 99%). Serially diluted antibodies were added to the plate and the plate was incubated at 37° C./5% $CO_2$ for 30 minutes. Purified normal human serum (GenScript, Cat. No. A01006, 20 μl per well) was then added to the plate and the plate was incubated further for 4 hours. The plate was taken out of the incubator and the supernatant was collected and tested with Cell Titer-Glo® assay kit (Cat. No. G7570, Promega). The luminescence data was captured by PheraStar microplate reader (BMG Labtech) for cell viability analysis. In house prepared IMAB362 analog (Claudiximab, Ganymed Pharmaceuticals AG) was used as a positive control.

Figure 2A:
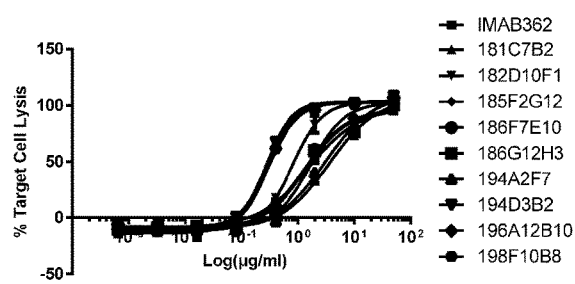
FIGS. 2A-2P. Non-humanized Claudin18.2 antibody-induced Complement Dependent Cytotoxicity (CDC) assay.
Figure 2B:
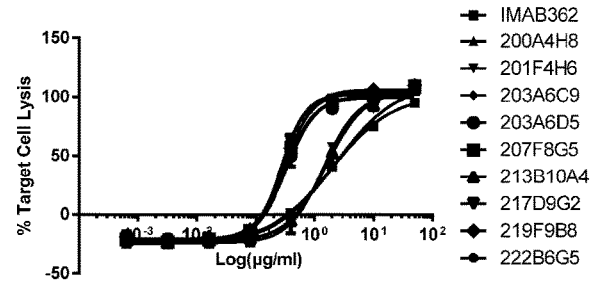
Figure 2C:
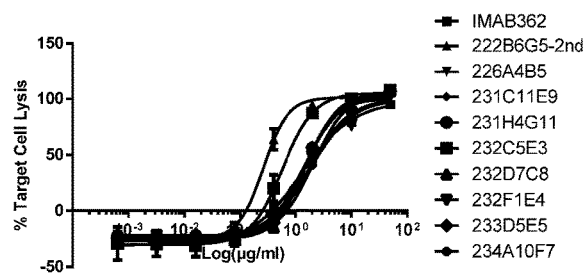
Figure 2D:
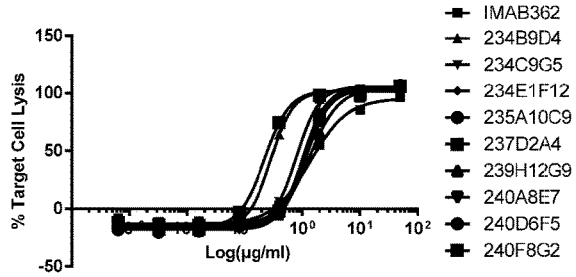
Figure 2E:
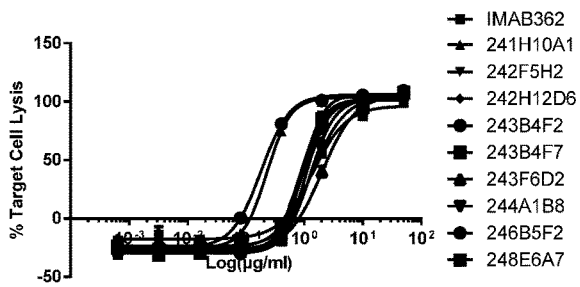
Figure 2F:
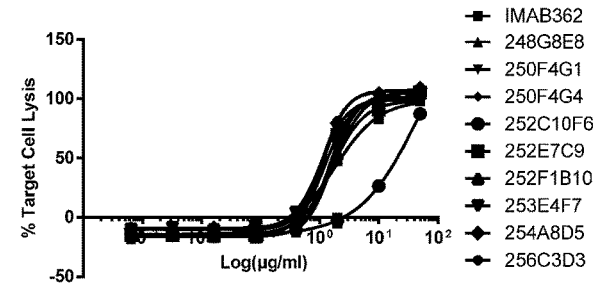
Figure 2G:
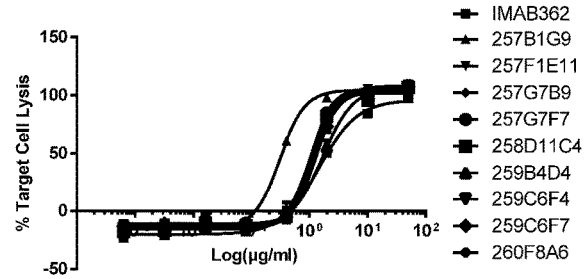
Figure 2H:
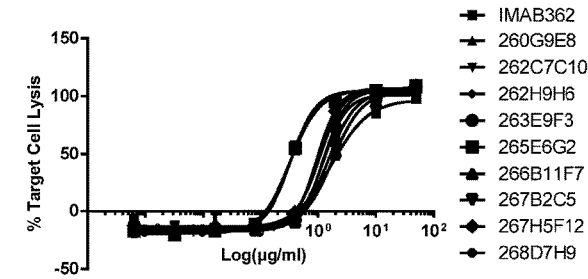
Figure 2I:
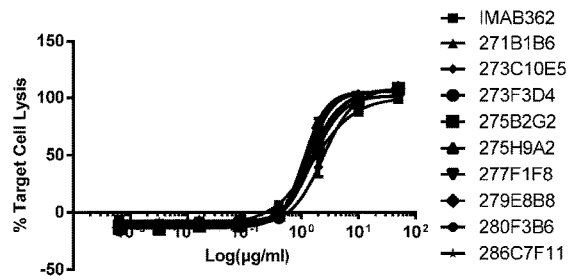
Figure 2J:
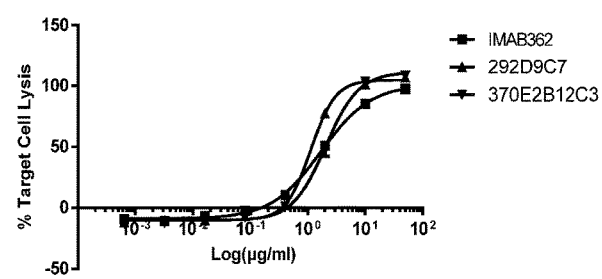
Figure 2K:
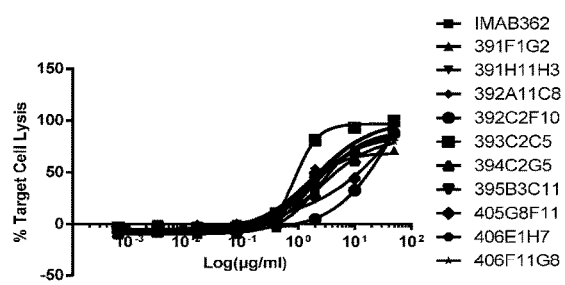
Figure 2L:
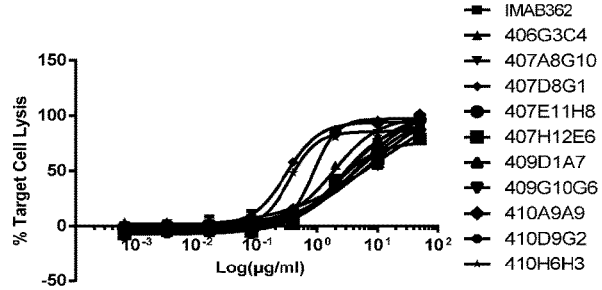
Figure 2M:
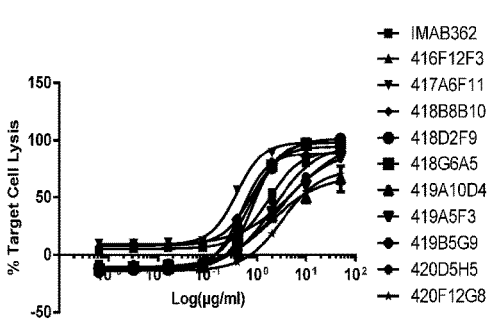
Figure 2N:
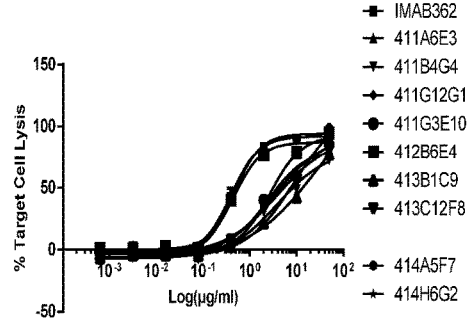
Figure 2O:
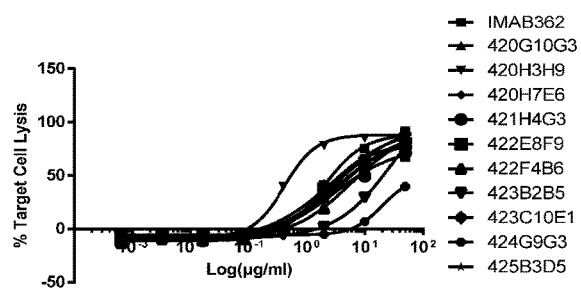
Figure 2P:
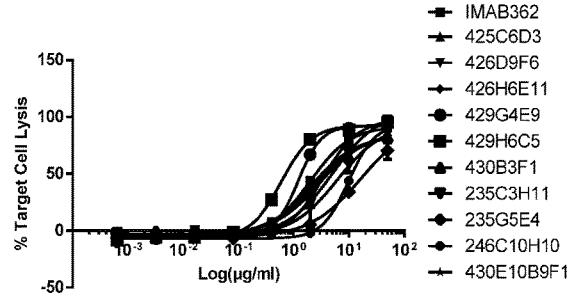

The CDC assay results were shown in FIG. 2A-2P, in terms of percent target cell lysis versus candidate antibody concentration. The EC$_{50}$ values and % Relative activity (% Relative activity=(EC$_{50}$ of the positive control/EC$_{50}$ of the candidate antibody)*100%) of antibodies were determined and summarized in Table 5 below.

Antibodies from several clones had lower EC$_{50}$ values than IMAB362. Several mAbs showing a relative activity of 200% or higher were listed in bold.

TABLE 5

CDC activity of mouse anti-Claudin18.2 monoclonal antibodies

| Antibody ID | EC$_{50}$ (μg/ml) | % Relative activity | Antibody ID | EC$_{50}$ (μg/ml) | % Relative activity |
|---|---|---|---|---|---|
| 181C7B2 | 3.592 | 43.99 | 271B1B6 | 1.124 | 145.11 |
| 182D10F1 | 0.811 | 194.77 | 273C10E5 | 2.413 | 67.59 |
| 185F2G12 | 0.291 | 542.58 | 273F3D4 | 1.557 | 104.75 |
| 186F7E10 | 1.274 | 124.02 | 275B2G2 | 1.657 | 98.43 |
| 186G12H3 | 1.39 | 113.67 | 275H9A2 | 1.147 | 142.2 |
| 194A2F7 | 3.055 | 51.72 | 277F1F8 | 1.544 | 105.63 |
| 194D3B2 | 0.275 | 573.71 | 279E8B8 | 1.268 | 128.63 |
| 196A12B10 | 1.688 | 93.6 | 280F3B6 | 1.352 | 120.64 |
| 198F10B8 | 0.3 | 525.97 | 286C7F11 | 1.523 | 107.09 |
| IMAB362 | 1.58 | 100 | IMAB362 | 1.631 | 100 |
| 200A4H8 | 2.267 | 84.52 | 292D9C7 | 1.135 | 151.19 |
| 201F4H6 | 1.418 | 135.12 | 370E2B12C3 | 0.453 | 379.23 |
| 203A6C9 | 0.319 | 600.06 | IMAB362 | 1.716 | 100 |
| 203A6D5 | 0.336 | 570.92 | 391F1G2 | 1.472 | 175.68 |
| 207F8G5 | 0.305 | 627.37 | 391H11H3 | 2.071 | 124.87 |
| 213B10A4 | 1.589 | 120.58 | 392A11C8 | 1.949 | 132.68 |
| 217D9G2 | 0.271 | 706.75 | 392C2F10 | 47.61 | 5.43 |
| 219F9B8 | 0.318 | 602.89 | 393C2C5 | 0.909 | 284.61 |
| 222B6G5 | 0.278 | 690.2 | 394C2G5 | 1.981 | 130.54 |
| IMAB362 | 1.916 | 100 | 395B3C11 | 1.798 | 143.83 |
| 222B6G5 | 0.259 | 501.35 | 405G8F11 | 3225 | 0.08 |
| 226A4B5 | 1.78 | 73.03 | 406E1H7 | 2.071 | 124.87 |
| 231C11E9 | 1.554 | 83.66 | 406F11G8 | 2.572 | 100.54 |
| 231H4G11 | 1.477 | 88.02 | IMAB362 | 2.586 | 100 |
| 232C5E3 | 0.575 | 226.05 | 406G3C4 | 1.925 | 135.64 |
| 232D7C8 | 1.463 | 88.86 | 407A8G10 | 10.91 | 23.93 |
| 232F1E4 | 1.735 | 74.93 | 407D8G1 | 0.308 | 848.83 |
| 233D5E5 | 1.489 | 87.31 | 407E11H8 | 4.322 | 60.41 |
| 234A10F7 | 2.098 | 61.96 | 407H12E6 | 1.828 | 142.83 |
| IMAB362 | 1.3 | 100 | 409D1A7 | 7.782 | 33.55 |
| 234B9D4 | 0.287 | 485 | 409G10G6 | 4.696 | 55.6 |
| 234C9G5 | 0.794 | 175.04 | 410A9A9 | 0.872 | 299.5 |
| 234E1F12 | 1.105 | 125.79 | 410D9G2 | 2.971 | 87.88 |
| 235A10C9 | 1.011 | 137.49 | 410H6H3 | 0.346 | 755.28 |
| 237D2A4 | 0.221 | 628.67 | IMAB362 | 2.611 | 100 |
| 239H12G9 | 1.363 | 101.98 | 411A6E3 | 2.497 | 109.05 |
| 240A8E7 | 1.157 | 120.14 | 411B4G4 | 3.984 | 68.35 |
| 240D6F5 | 1.167 | 119.11 | 411G12G1 | 9.56 | 28.48 |
| 240F8G2 | 1.103 | 126.02 | 411G3E10 | 3.311 | 82.24 |
| IMAB362 | 1.39 | 100 | 412B6E4 | 0.472 | 576.78 |
| 241H10A1 | 0.225 | 625.33 | 413B1C9 | 26.29 | 10.36 |
| 242F5H2 | 0.944 | 149.06 | 413C12F8 | 3.839 | 70.93 |
| 242H12D6 | 1.26 | 111.67 | 414A5F7 | 0.458 | 594.15 |
| 243B4F2 | 1.047 | 134.38 | 414H6G2 | 0.402 | 678.04 |
| 243B4F7 | 0.941 | 149.47 | IMAB362 | 2.723 | 100 |
| 243F6D2 | 1.997 | 70.46 | | | |
| 244A1B8 | 1.385 | 101.59 | 416F12F3 | 0.784 | 219.78 |
| 246B5F2 | 0.179 | 787.35 | 417A6F11 | 0.392 | 439.51 |
| 248E6A7 | 0.876 | 160.54 | 418B8B10 | 5.596 | 30.77 |
| IMAB362 | 1.407 | 100 | 418D2F9 | 0.73 | 236.02 |
| 248G8E8 | 1.61 | 113.85 | 418G6A5 | 0.83 | 207.49 |
| 250F4G1 | 1.642 | 111.63 | 419A10D4 | 1.883 | 91.45 |
| 250F4G4 | 1.451 | 126.33 | 419A5F3 | 2.791 | 61.7 |
| 252C10F6 | 53.63 | 3.42 | 419B5G9 | 0.494 | 348.79 |
| 252E7C9 | 1.19 | 154.03 | 420D5H5 | 2.2 | 78.27 |
| 252F1B10 | 1.763 | 103.97 | 420F12G8 | 3.271 | 52.64 |
| 253E4F7 | 1.056 | 173.58 | IMAB362 | 1.722 | 100 |
| 254A8D5 | 1.188 | 154.29 | 420G10G3 | 2.633 | 72.39 |
| 256C3D3 | 1.114 | 164.54 | 420H3H9 | 0.416 | 458.5 |
| IMAB362 | 1.833 | 100 | 420H7E6 | 3.905 | 48.81 |
| 257B1G9 | 0.305 | 487.39 | 421H4G3 | 2.892 | 65.91 |
| 257F1E11 | 0.855 | 174.1 | 422E8F9 | 2.136 | 89.23 |
| 257G7B9 | 1.009 | 147.47 | 422F4B6 | 6.026 | 31.63 |
| 257G7F7 | 1.059 | 140.51 | 423B2B5 | 29.89 | 6.38 |
| 258D11C4 | 1.051 | 141.58 | 423C10E1 | 3.392 | 56.19 |
| 259B4D4 | 1.688 | 88.15 | 424G9G3 | 20.31 | 9.38 |
| 259C6F4 | 1.186 | 125.46 | 425B3D5 | 3.023 | 63.05 |
| 259C6F7 | 1.274 | 116.8 | IMAB362 | 1.906 | 100 |
| 260F8A6 | 1.152 | 129.17 | 425C6D3 | 2.082 | 96.59 |
| IMAB362 | 1.488 | 100 | 426D9F6 | 6.209 | 32.39 |
| 260G9E8 | 1.051 | 163.75 | 426H6E11 | 2.513 | 80.02 |
| 262C7C10 | 0.331 | 520.41 | 429G4E9 | 1.229 | 163.63 |
| 262H9H6 | 0.941 | 182.83 | 429H6C5 | 0.607 | 331.14 |
| 263E9F3 | 1.479 | 116.36 | 430B3F1 | 2.865 | 70.19 |
| 265E6G2 | 0.327 | 526.3 | 235C3H11 | 5.097 | 39.45 |
| 266B11F7 | 1.767 | 97.4 | 235G5E4 | 16.63 | 12.09 |

TABLE 5-continued

CDC activity of mouse anti-Claudin18.2 monoclonal antibodies

| Antibody ID | EC$_{50}$ (μg/ml) | % Relative activity | Antibody ID | EC$_{50}$ (μg/ml) | % Relative activity |
|---|---|---|---|---|---|
| 267B2C5 | 1.208 | 142.47 | 246C10H10 | 9.902 | 20.31 |
| 267H5F12 | 1.003 | 171.59 | 430E10B9F1 | 3.389 | 59.34 |
| 268D7H9 | 1.226 | 140.38 | IMAB362 | 2.011 | 100 |
| IMAB362 | 1.721 | 100 | | | |

Anti-Claudin18.2 Mouse Antibody Bound to Claudin18.2-Expressing HEK293T Cells

To determine protein binding EC$_{50}$ by Cell ELISA, 96-well U-bottom microplates were pre-blocked with blocking buffer (5% MPBS, 1×PBS with 5% skim milk) overnight at 4° C. On the next day, the Claudin18.2-expressing HEK293T stable cell line was suspended at 1.5×10$^6$ cells/ml in blocking buffer, added to the plate in 100 μl/well and incubated at room temperature for 1 hour. Then the wells were incubated with serially diluted anti-Claudin18.2 antibodies at room temperature for 1 hour, three-fold dilution with initial concentrations of 50.0 nM, followed by HRP-conjugated goat anti-mouse IgG (H+L) (1:10000, Rockland Immunochemicals, Inc., Cat.: 610-103-121) for substrate TMB chromogenic reaction. The IMAB362 analog was used as positive control, a mouse IgG and human IgG1Fc were used as isotype controls.

The HEK293T cell line overexpressing human Claudin18.2 as used above was generated using HIV-1-based lentivirus. Lentivirus overexpressing Claudin18.2 (NCBI, NP_001002026.1) were packaged, collected by ultracentrifugation and used to infect HEK293T cells. The infected cell pools were selected with selection antibiotics of puromycin for more than one week and the expression of Claudin 18.2 was verified by FACS. Cells were diluted to 96-well plates to generate single cell clones.

Figure 3A:
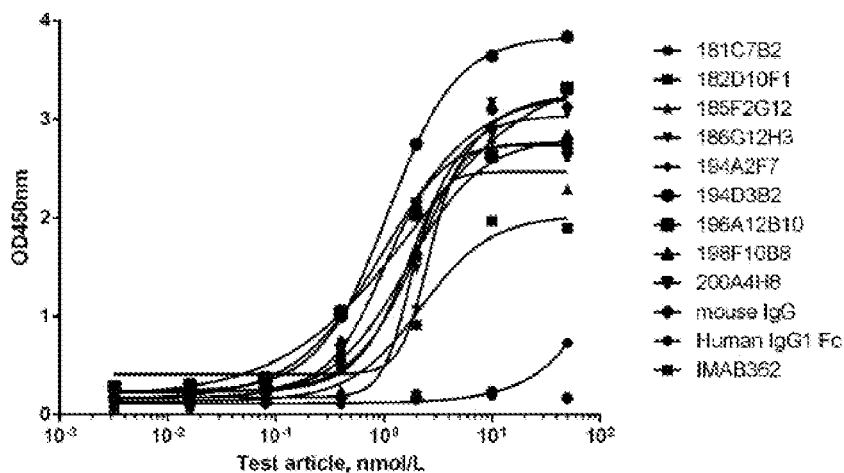
FIGS. 3A-3Q. Non-humanized Claudin18.2 antibody cell-based ELISA assay.
Figure 3B:
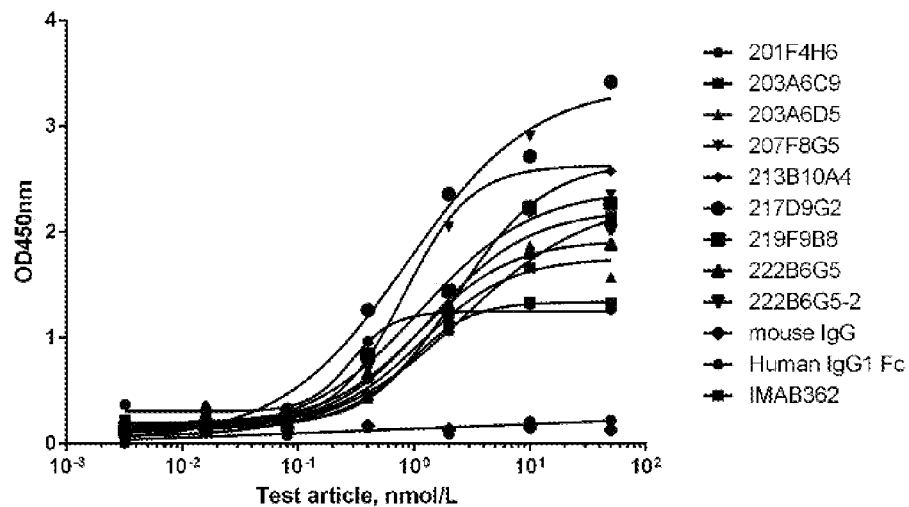
Figure 3C:
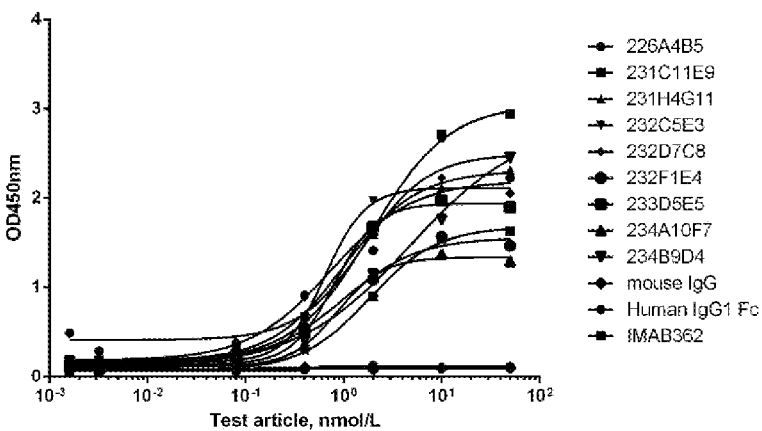
Figure 3D:
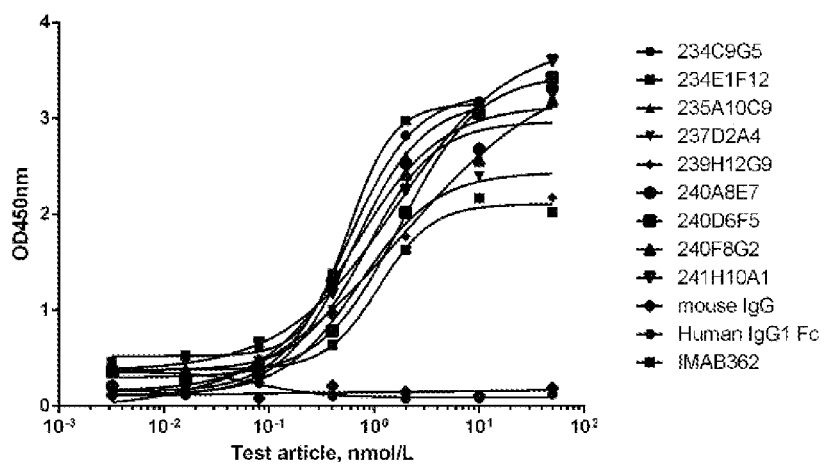
Figure 3E:
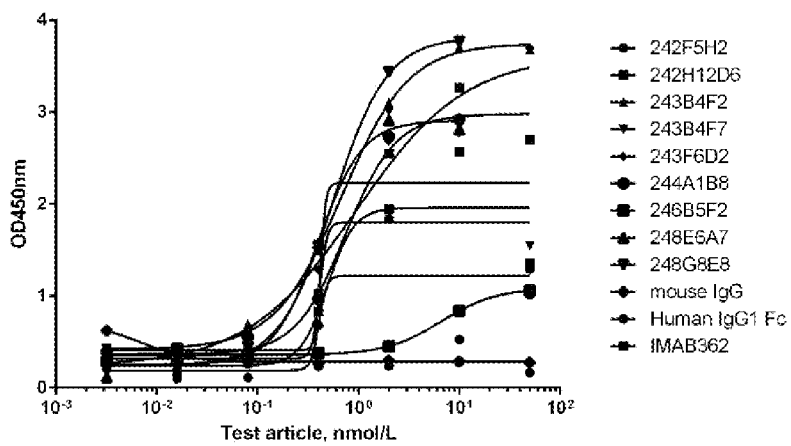
Figure 3F:
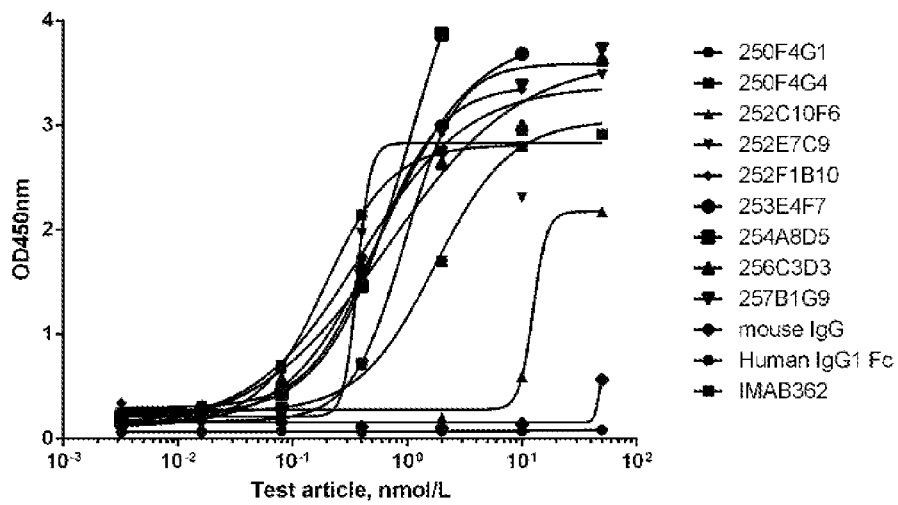
Figure 3G:
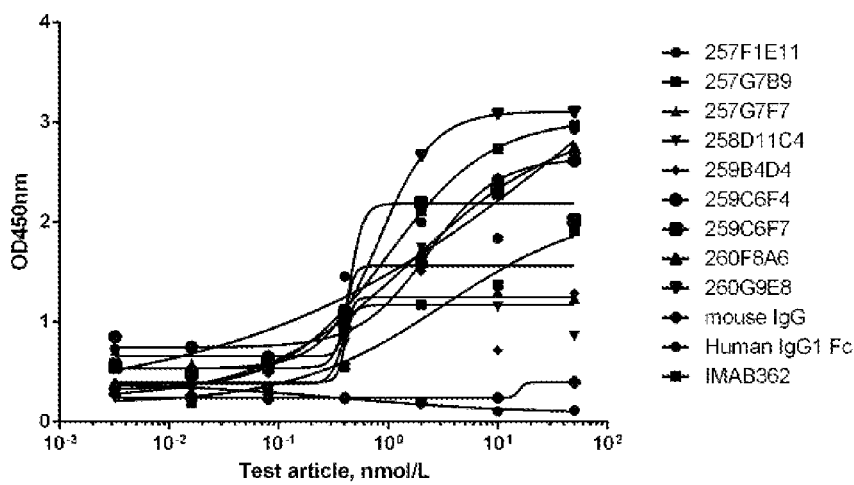
Figure 3H:
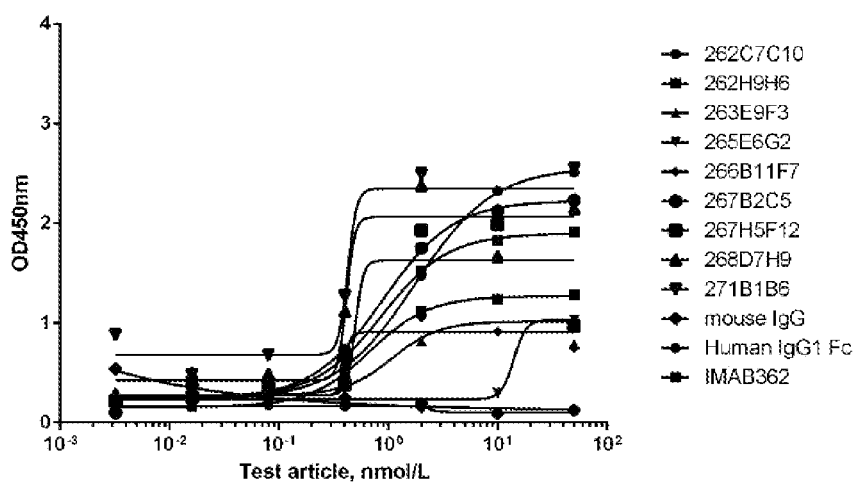
Figure 3I:
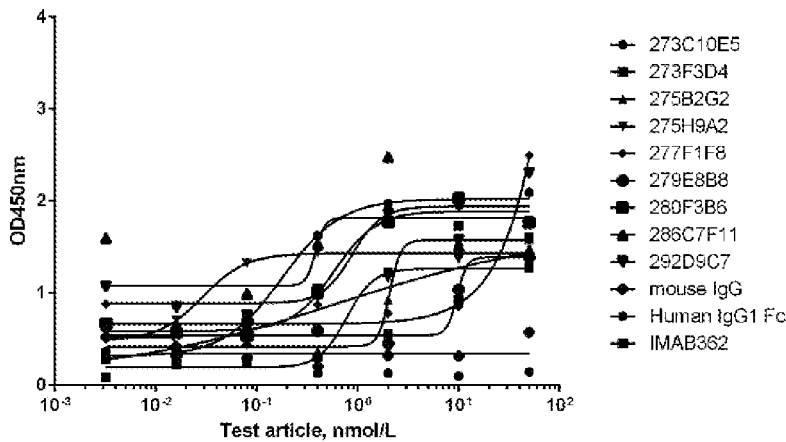
Figure 3J:
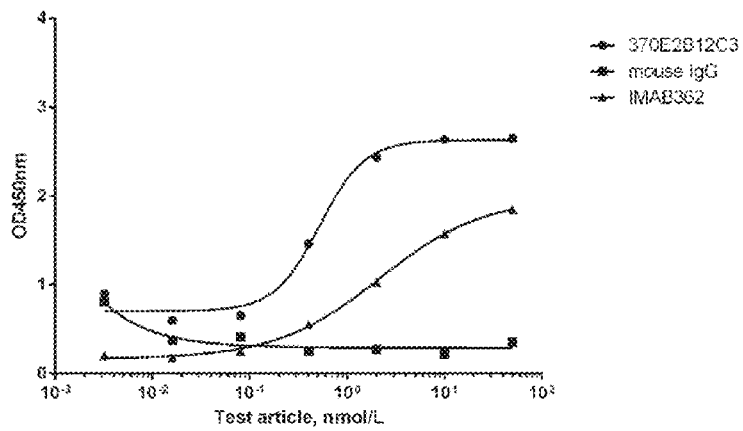
Figure 3K:
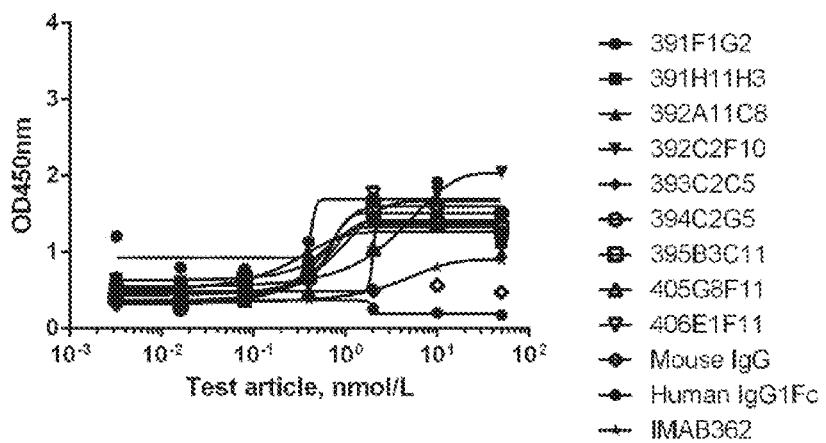
Figure 3L:
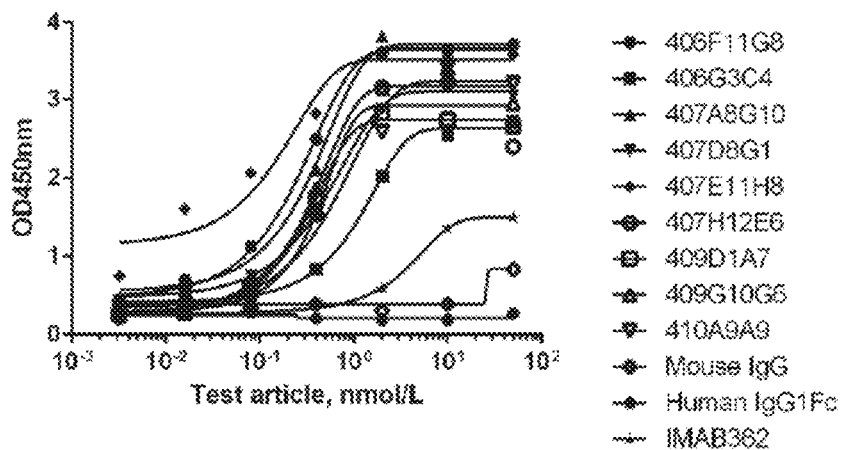
Figure 3M:
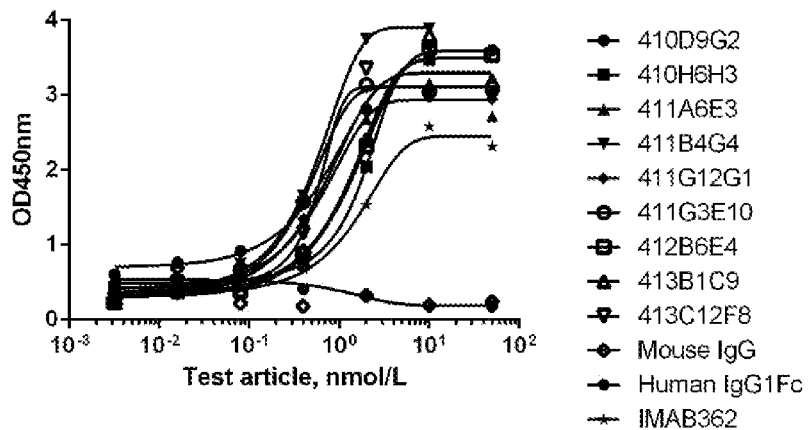
Figure 3N:
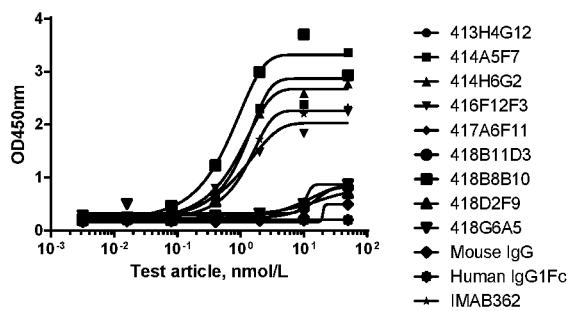
Figure 3O:
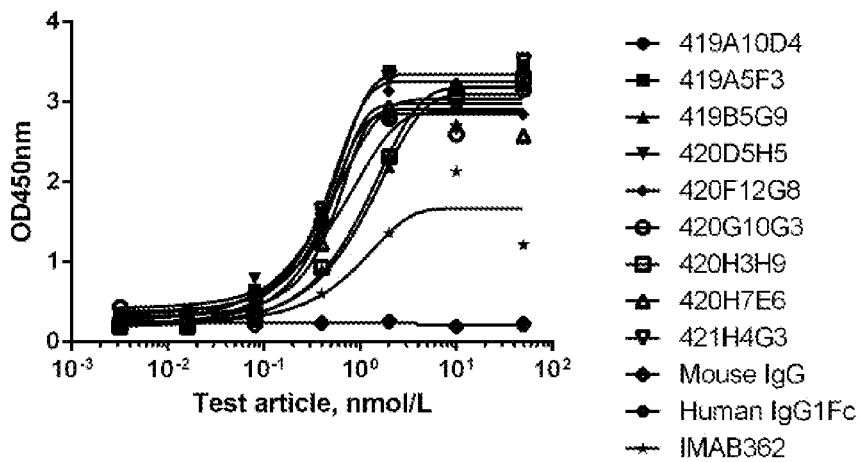
Figure 3P:
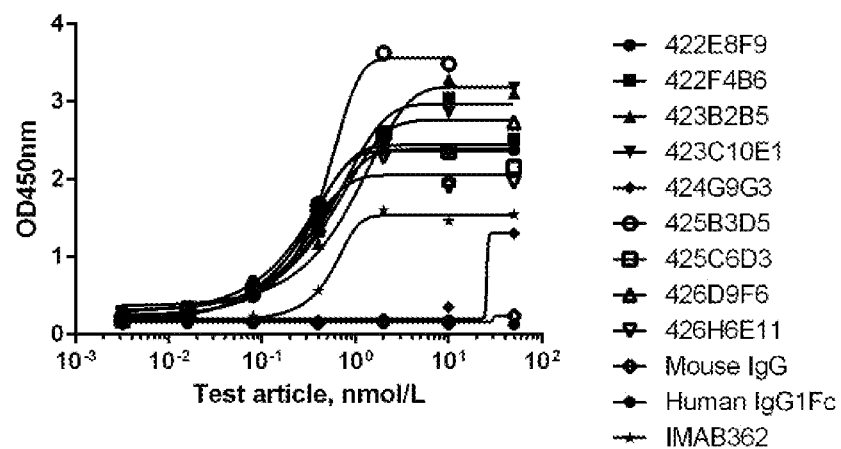
Figure 3Q:
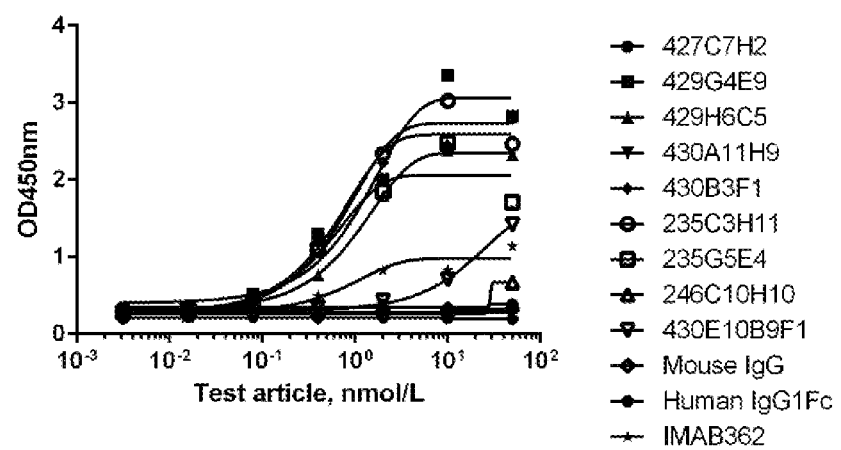

Antibody-Claudin18.2 binding curves were generated with optical density readings at 450 nm and shown in FIGS. 3A-3Q. Raw data were plotted with GraphPad Prism v6.02 software with four parameters, best-fit value program to analyze the EC$_{50}$. The ELISA binding EC$_{50}$ values were summarized in Table 6.

The data showed that several antibodies had better Claudin18.2 binding efficiency and/or potency than IMAB362.

TABLE 6

Cell ELISA binding EC$_{50}$ of mouse anti-Claudin18.2 Abs

| Antibody ID | EC$_{50}$ (nM) | Antibody ID | EC$_{50}$ (nM) | Antibody ID | EC$_{50}$ (nM) |
|---|---|---|---|---|---|
| 200A4H8 | 1.01 | 201F4H6 | 0.2827 | 232C5E3 | 0.6514 |
| 181C7B2 | 1.072 | 207F8G5 | 0.8218 | 232D7C8 | 0.7379 |
| 194D3B2 | 1.086 | 217D9G2 | 0.9081 | 233D5E5 | 0.8029 |
| 182D10F1 | 1.646 | 203A6C9 | 0.9163 | 234A10F7 | 0.857 |
| 185F2G12 | 1.725 | 222B6G5 | 1.126 | 232F1E4 | 0.9663 |
| 196A12B10 | 1.78 | 219F9B8 | 1.155 | 231H4G11 | 1.013 |
| 198F10B8 | 1.818 | 203A6D5 | 1.164 | 226A4B5 | 1.586 |
| IMAB362 | 2.173 | 222B6G5-2 | 1.379 | IMAB362 | 1.816 |
| 186G12H3 | 2.213 | 213B10A4 | 2.328 | 231C11E9 | 1.912 |
| 194A2F7 | 2.574 | IMAB362 | 2.609 | 234B9D4 | 4.781 |
| 234C9G5 | 0.562 | 248E6A7 | 0.3959 | 250F4G4 | 0.1989 |
| 234E1F12 | 0.57 | IMAB362 | 0.4895 | 250F4G1 | 0.4147 |
| 235A10C9 | 0.6297 | 248G8E8 | 0.5604 | 252F1B10 | 0.5297 |
| 240A8E7 | 0.6459 | 243B4F2 | 0.6839 | 253E4F7 | 0.6114 |
| 239H12G9 | 0.7324 | 242H12D6 | 0.7444 | 256C3D3 | 0.7285 |
| 240F8G2 | 0.8797 | 243F6D2 | 0.96 | 257B1G9 | 0.948 |
| IMAB362 | 1.114 | 246B5F2 | 6.593 | 254A8D5 | 0.982 |
| 241H10A1 | 1.66 | 242F5H2 | ~0.4027 | IMAB362 | 1.729 |
| 240D6F5 | 1.769 | 243B4F7 | ~0.4107 | 252E7C9 | ~0.3702 |
| 237D2A4 | 1.902 | 244A1B8 | ~0.4388 | 252C10F6 | ~2.50 |
| 260G9E8 | 0.8209 | IMAB362 | 0.6746 | 273C10E5 | 0.1811 |
| 257G7B9 | 1.022 | 262H9H6 | 0.8793 | 280F3B6 | 0.5823 |
| 260F8A6 | 1.797 | 267B2C5 | 0.8951 | IMAB362 | 0.77 |
| 259C6F4 | 2.319 | 263E9F3 | 1.077 | 292D9C7 | 0.8746 |
| IMAB362 | 3.35 | 262C7C10 | 1.767 | 273F3D4 | 1.131 |
| 257F1E11 | 57.84 | 266B11F7 | ~0.3969 | 275H9A2 | ~0.0 |
| 259B4D4 | ~0.3780 | 268D7H9 | ~0.4114 | 275B2G2 | ~2.064 |
| 258D11C4 | ~0.4058 | 271B1B6 | ~0.4288 | 277F1F8 | ~4411 |
| 257G7F7 | ~0.4128 | 267H5F12 | ~0.5129 | 279E8B8 | ~9.619 |
| 259C6F7 | ~0.4429 | 265E6G2 | ~14.00 | 286C7F11 | ~0.08310 |
| 391F1G2 | ~2.663 | 406F11G8 | 1.829 | 410D9G2 | 4.331 |
| 391H11H3 | 2.973 | 406G3C4 | 12.64 | 410H6H3 | 45.51 |
| 392A11C8 | 1.213 | 407A8G10 | 2.137 | 411A6E3 | ~2.600 |
| 392C2F10 | 350 | 407D8G1 | 2.38 | 411B4G4 | 2.854 |
| 393C2C5 | 4.446 | 407E11H8 | 1.244 | 411G12G1 | 3.474 |
| 394C2G5 | 2.814 | 407H12E6 | 2.394 | 411G3E10 | 2.448 |
| 395B3C11 | 3.577 | 409D1A7 | 2.052 | 412B6E4 | 33.08 |
| 405G8F11 | ~91.19 | 409G10G6 | 2.188 | 413B1C9 | 24.59 |
| 406E1H7 | 4.328 | 410A9A9 | 6.206 | 413C12F8 | 3.547 |
| IMAB362 | 25.26 | IMAB362 | 2.607 | IMAB362 | 31.91 |
| 413H4G12 | No binding | 419A10D4 | 2.331 | 422E8F9 | 1.88 |

TABLE 6-continued

Cell ELISA binding EC$_{50}$ of mouse anti-Claudin18.2 Abs

| Antibody ID | EC$_{50}$ (nM) | Antibody ID | EC$_{50}$ (nM) | Antibody ID | EC$_{50}$ (nM) |
|---|---|---|---|---|---|
| 414A5F7 | 15.49 | 419A5F3 | 2.612 | 422F4B6 | 2.531 |
| 414H6G2 | 12.01 | 419B5G9 | 22.51 | 423B2B5 | 12.71 |
| 416F12F3 | 14.66 | 420D5H5 | 7.026 | 423C10E1 | 2.462 |
| 417A6F11 | Low binding | 420F12G8 | 2.612 | 424G9G3 | * |
| 418B11D3 | Low binding | 420G10G3 | 2.394 | 425B3D5 | 2.612 |
| 418B8B10 | 3.168 | 420H3H9 | 20.68 | 425C6D3 | 1.923 |
| 418D2F9 | Low binding | 420H7E6 | 2.941 | 426D9F6 | 2.144 |
| 418G6A5 | Low binding | 421H4G3 | 2.468 | 426H6E11 | 1.778 |
| IMAB362 | 18.73 | IMAB362 | 9.106 | IMAB362 | 3.409 |
| 427C7H2 | Low binding | 370E2B12C3 | 0.522 | | |
| 429H6C5 | 13.19 | IMAB362 | 2.163 | | |
| 430A11H9 | ~1.702 | | | | |
| 430B3F1 | 2.563 | | | | |
| 235C3H11 | 5.823 | | | | |
| 235G5E4 | 2.303 | | | | |
| 246C10H10 | Low binding | | | | |
| 430E10B9F1 | * | | | | |
| IMAB362 | 3.846 | | | | |

*Maximum binding plateau not reached

Anti-Claudin18.2 mAbs showing good properties were sequenced, and their heavy/light chain variable region and CDR sequences or sequence ID numbers were summarized in Table 1 and Table 2. Some of these antibodies were subject to further characterization.

Example 3. Preparation and Characterization of Chimeric Anti-Claudin18.2 Antibody Preparation of Chimeric Antibodies Heavy chain and light chain variable region coding sequences for the selected mAbs were optimized for human codon biased expression with GenScript Optimum-Gene™—Codon Optimization. The heavy chain and light chain variable region coding DNA fragments were synthesized and fused to nucleotides encoding human IgG1 heavy chain domain (CH1-hinge-CH2-CH3, amino acid set forth in SEQ ID NO: 388) and light chain kappa constant region (CL, amino acid set forth in SEQ ID NO: 389), respectively, for transient expression in chimeric formats, wherein the C-terminus of the heavy chain variable region was linked to the N-terminus of human IgG1 heavy chain constant region, and the C-terminus of the light chain variable region was linked to the N-terminus of human kappa constant region. The heavy chain and light chain expression constructs were cloned into individual pTT5-based plasmids downstream of a synthesized signal peptide for secretory expression.

The chimeric antibodies were expressed in HEK293-6E cells transfected with antibody heavy chain/light chain pair plasmids using PEImax 40,000 (Cat No. 24765-1, Polysciences, Inc.). 24 hours later, the expression/secretion was boosted with the addition of Tryptone N-1 supplement. After 5 days of shaking culture in 37° C., 5% CO$_2$, supernatants were collected and the antibody content was purified with Protein-A beads. Chimeric antibody products were stored in PBS for analysis.

Chimeric Antibody FACS Binding Analysis

The binding of chimeric antibodies to Claudin18.2 expressed on HEK293 cells was determine by FACS analysis. Briefly, HEK293 cells expressing human Claudin18.2 as prepared in the foregoing Example were harvested and incubated with anti-Claudin18.2 mAbs at 4° C. for 40 min, followed by fluorophore (iFluor 647)-labeled goat anti-mouse IgG (H+L) secondary antibodies at 4° C. for 0.5 hour.

Figure 4A:
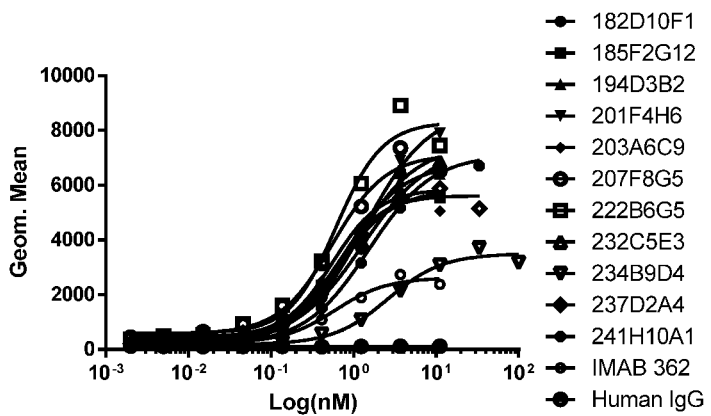
FIGS. 4A-4C. Chimeric antibody FACS binding assay.
Figure 4B:
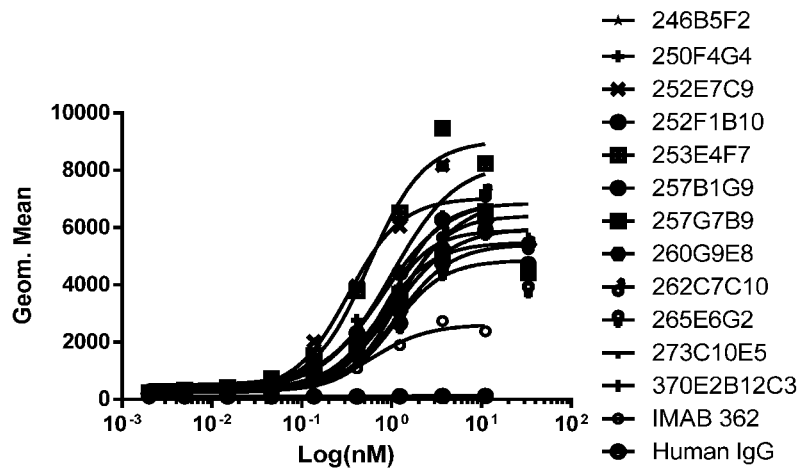
Figure 4C:
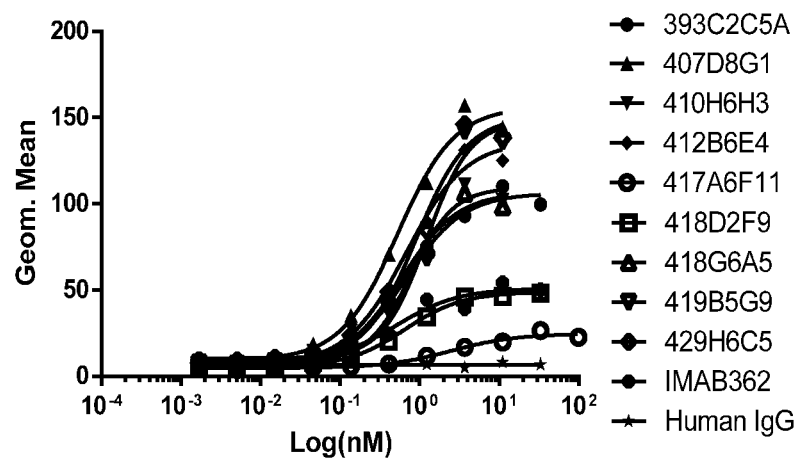

The samples were then analyzed by flow cytometry. Results were summarized in FIGS. 4A-4C, Table 7 and Table 8.

TABLE 7

Binding capacity of chimeric antibody to Claudin18.2-HEK293 cells

| Antibody ID | EC$_{50}$ (nM) | Antibody ID | EC$_{50}$ (nM) |
|---|---|---|---|
| 182D10F1 | 1.304 | 250F4G4 | 1.017 |
| 185F2G12 | 0.634 | 252E7C9 | 0.331 |
| 194D3B2 | 0.796 | 252F1B10 | 0.798 |
| 201F4H6 | 1.364 | 253E4F7 | 0.561 |
| 203A6C9 | 0.551 | 257B1G9 | 1.165 |
| 207F8G5 | 0.554 | 257G7B9 | 0.742 |
| 222B6G5 | 0.610 | 260G9E8 | 1.047 |
| 232C5E3 | 1.054 | 262C7C10 | 1.174 |
| 234B9D4 | 2.601 | 265E6G2 | 1.047 |
| 237D2A4 | 0.596 | 273C10E5 | 1.011 |
| 241H10A1 | 1.530 | 370E2B12C3 | 0.792 |
| 246B5F2 | 1.237 | IMAB 362 | 0.596 |

TABLE 8

Binding capacity of chimeric antibody to Claudin18.2-HEK293 cells

| Antibody ID | EC$_{50}$ (nM) |
|---|---|
| 393C2C5A | 0.687 |
| 407D8G1 | 0.533 |
| 410H6H3 | 0.778 |
| 412B6E4 | 0.677 |
| 417A6F11 | 2.477 |
| 418D2F9 | 0.650 |
| 418G6A5 | 0.595 |
| 419B5G9 | 1.230 |
| 429H6C5 | 0.908 |
| IMAB362 | 0.517 |

The chimeric antibodies showed comparable or higher binding capacity to cell surface expressed Claudin18.2 as compared IMAB363 benchmark. In particular, 203A6C9, 207F8G5, 252E7C9, and 253E4F7 exhibited higher binding efficacy and specific targeting capability than IMAB362.

Binding to Claudin18.1-HEK293 cells was negative by FACS analysis for all of the antibodies (data not shown).

Anti-Claudin18.2 Antibody Induced CDC

A CDC assay was conducted for the chimeric antibodies, according to the protocol described in Example 2.

Figure 5A:
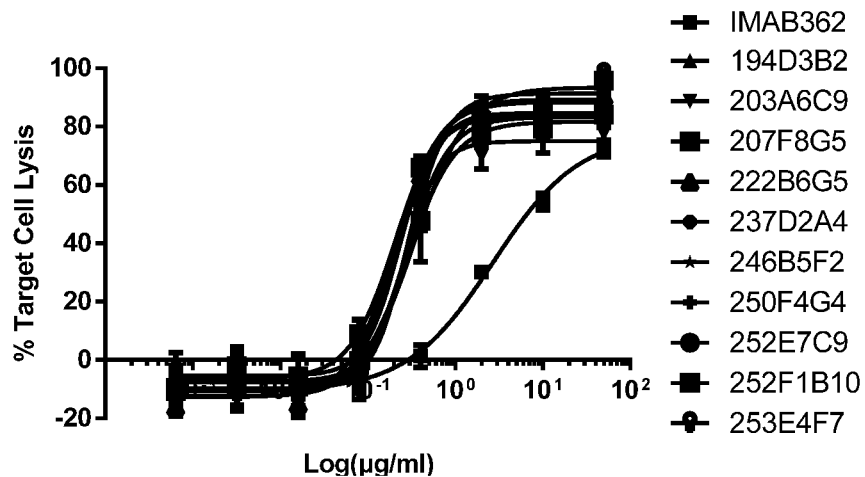
FIGS. 5A-5C. Chimeric antibody CDC induction assay.
Figure 5B:
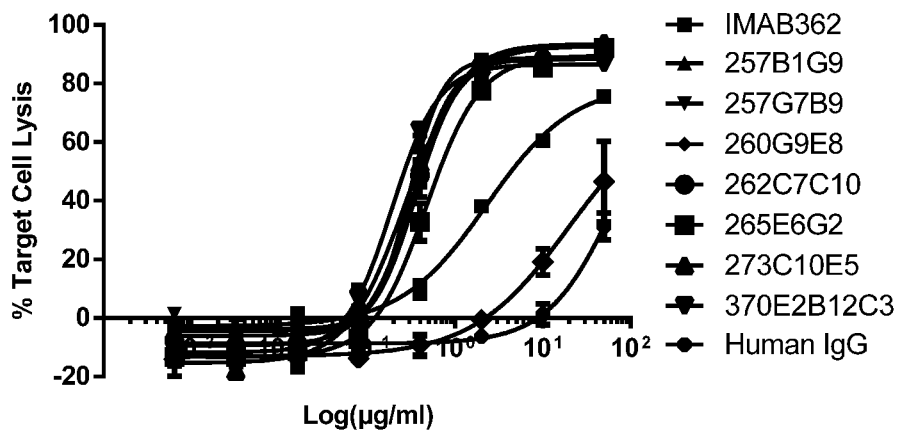
Figure 5C:
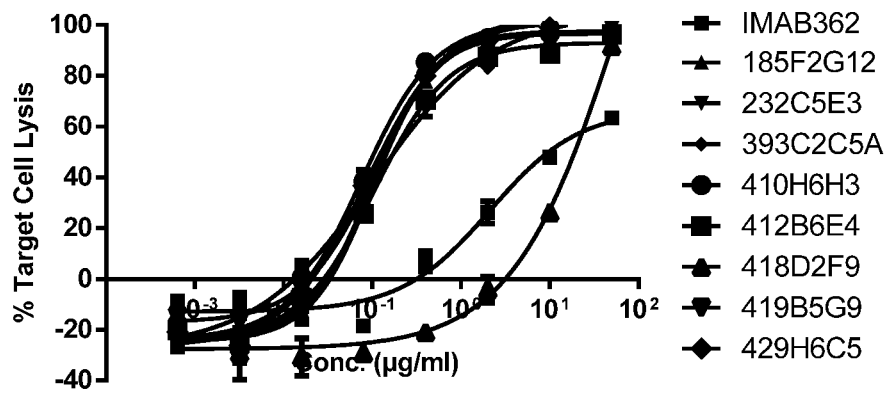
Figure 6A:
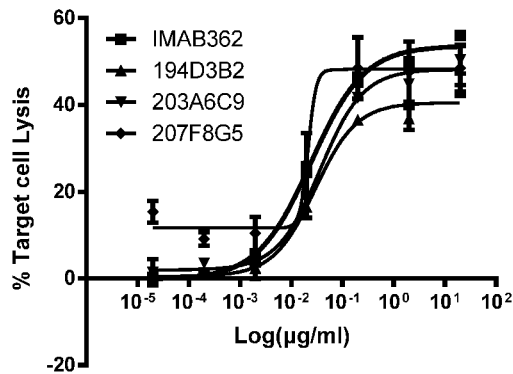
FIGS. 6A-6J. Chimeric antibody Antibody-Dependent Cell-Mediated Cytotoxicity (ADCC) induction assay.
Figure 6B:
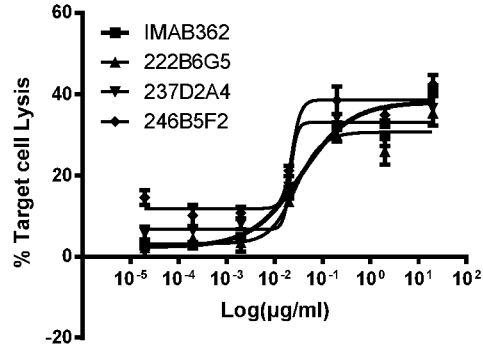
Figure 6C:
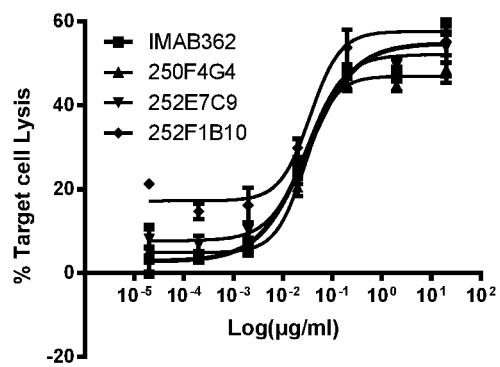
Figure 6D:
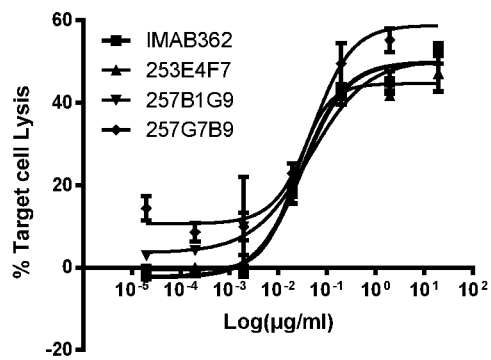
Figure 6E:
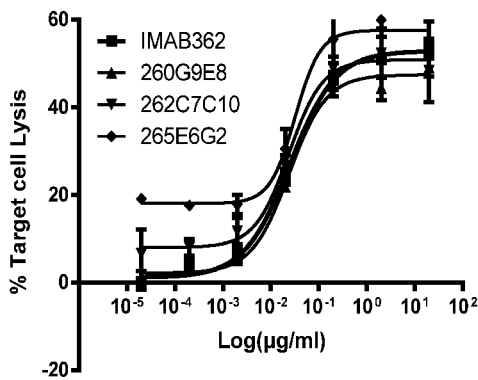
Figure 6F:
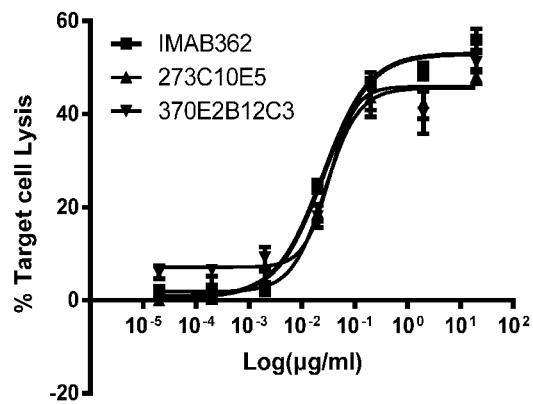
Figure 6G:
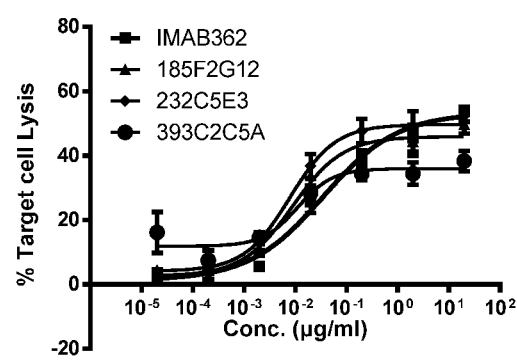
Figure 6H:
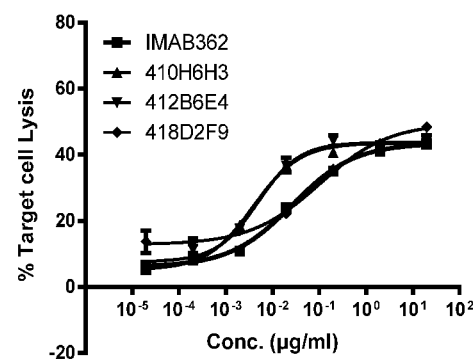
Figure 6I:
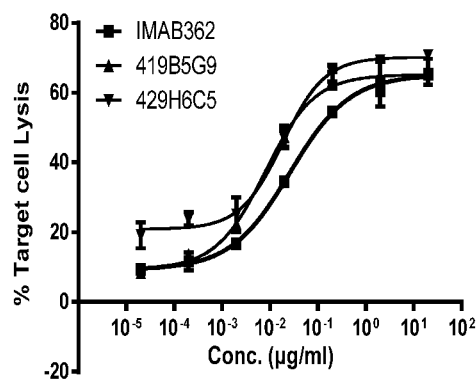
Figure 6J:
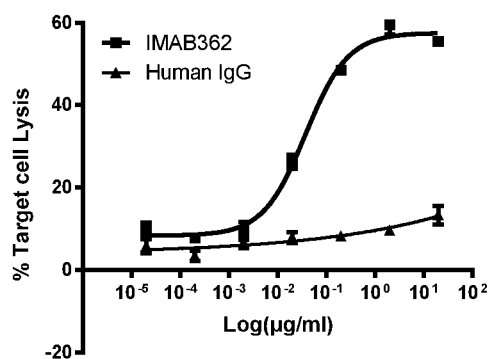
Figure 7A:
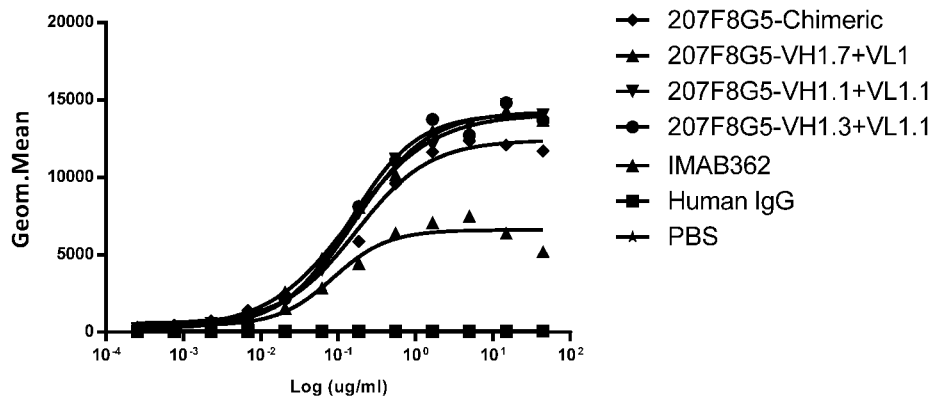
FIG. 7A-7G. Humanized antibody FACS binding assay.
Figure 7B:
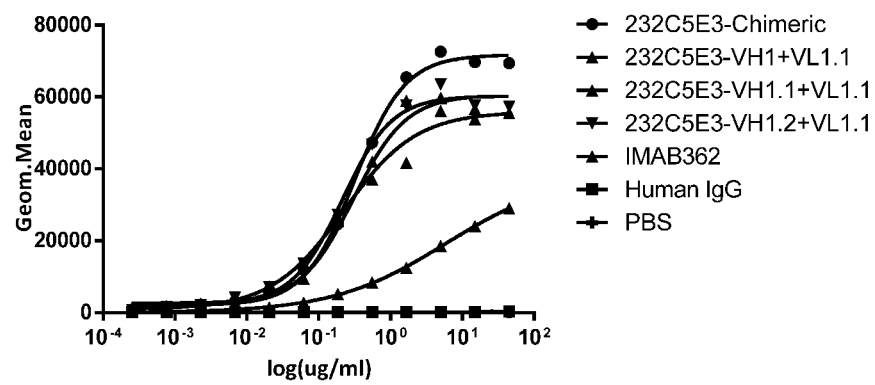
Figure 7C:
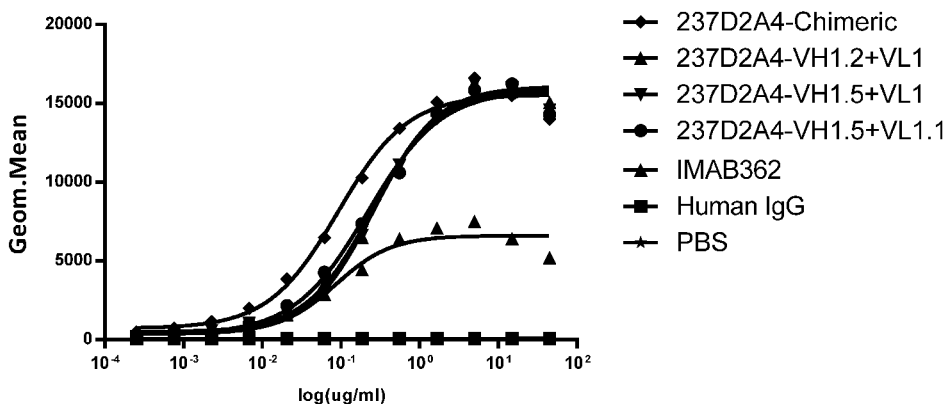
Figure 7D:
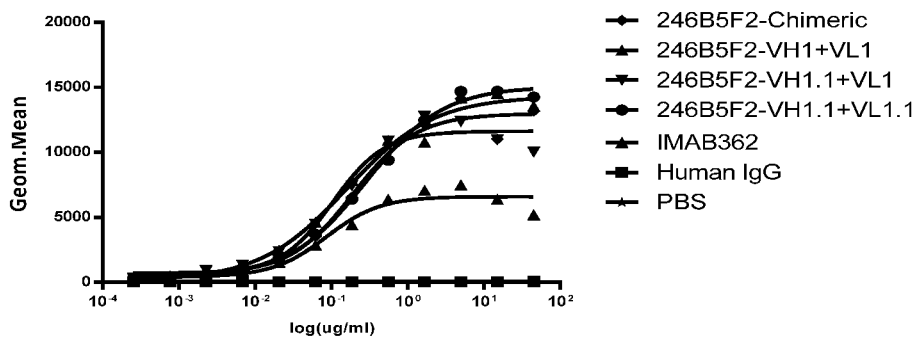
Figure 7E:
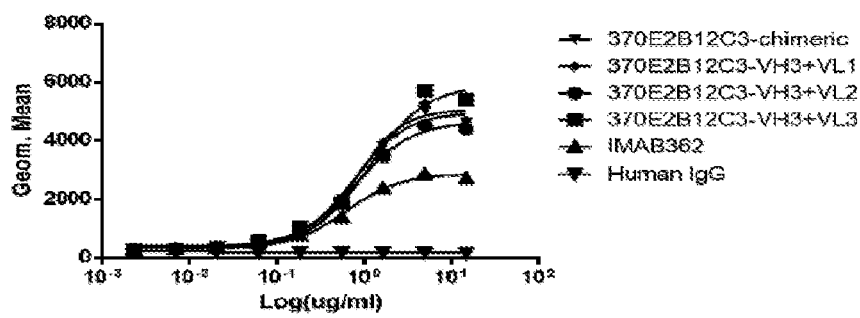
Figure 7F:
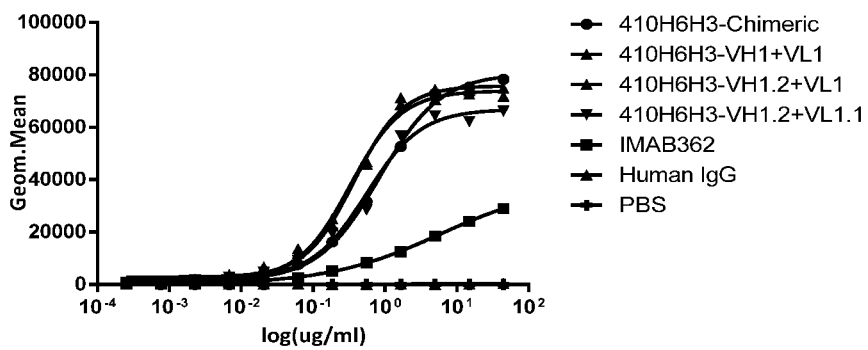
Figure 7G:
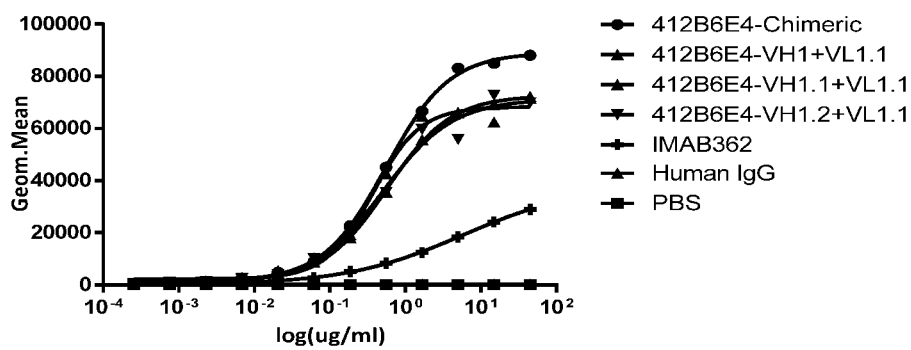
Figure 8A:
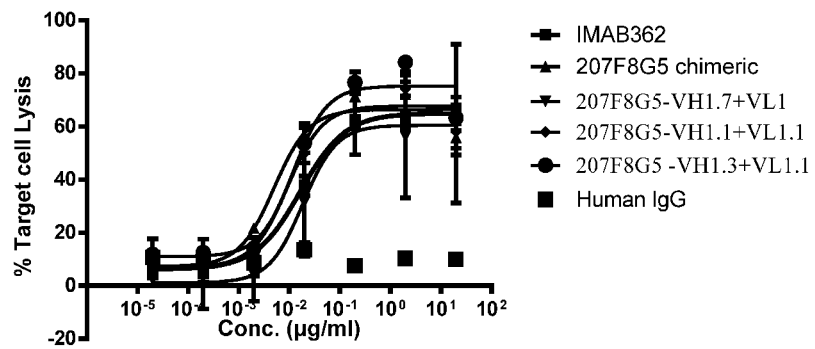
FIG. 8A-8H. Humanized antibody CDC induction assay.
Figure 8B:
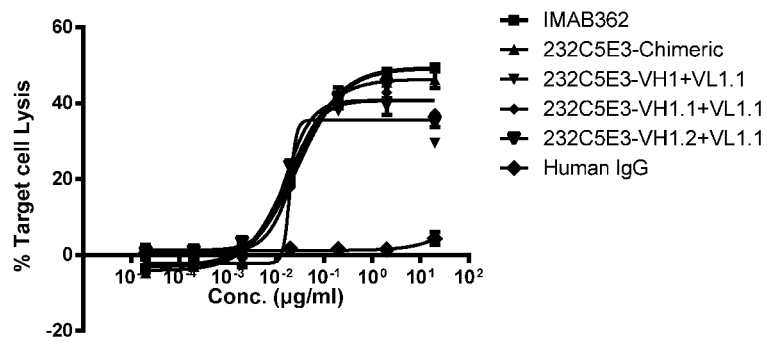
Figure 8C:
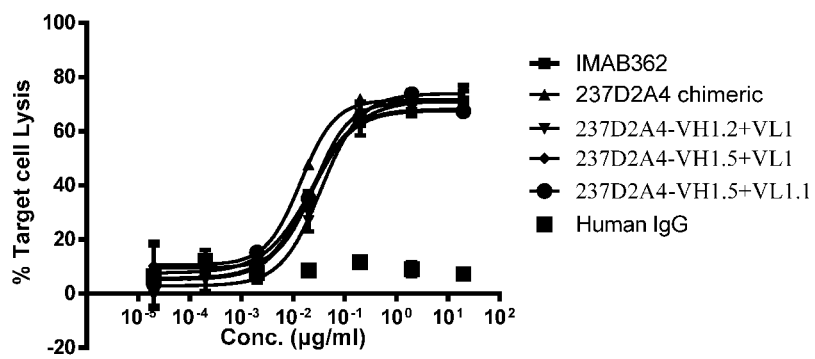
Figure 8D:
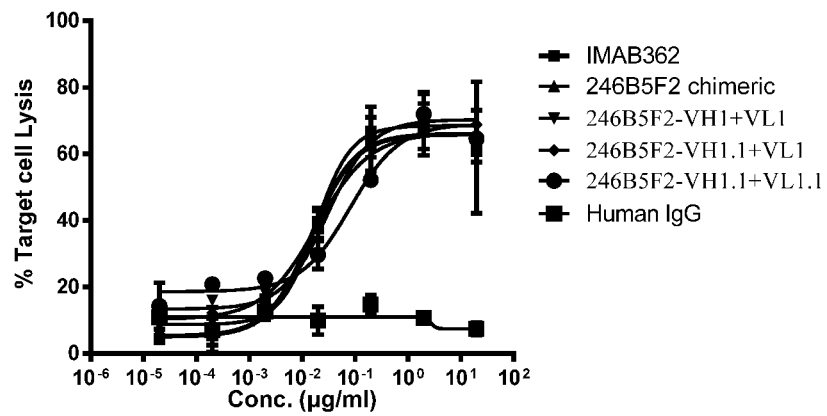
Figure 8E:
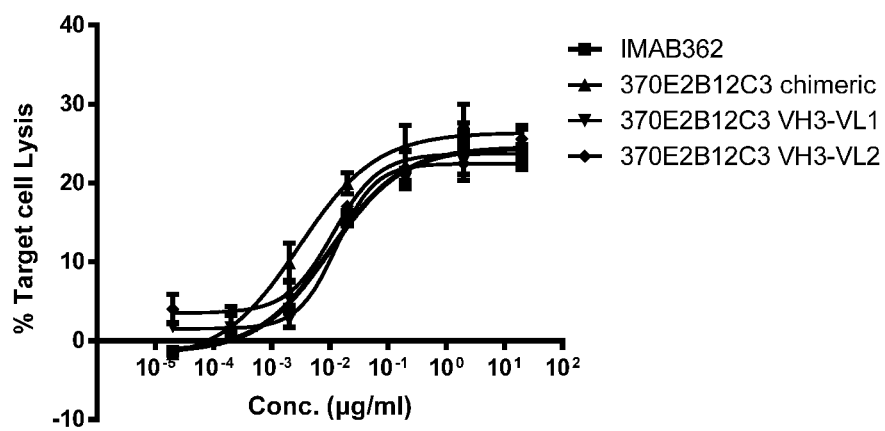
Figure 8F:
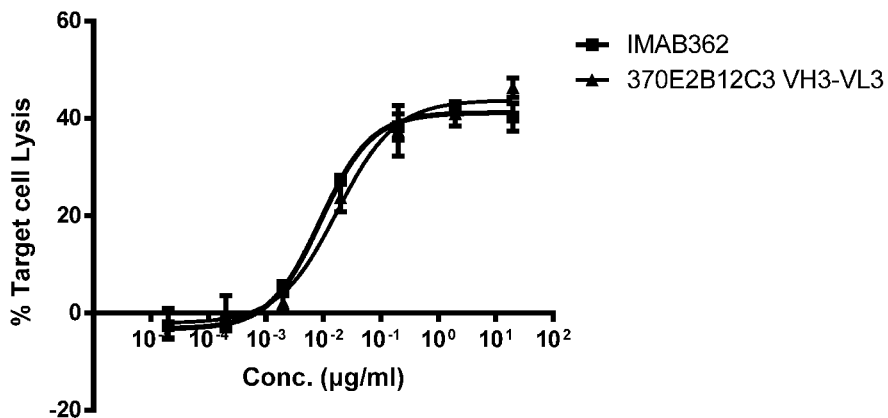
Figure 8G:
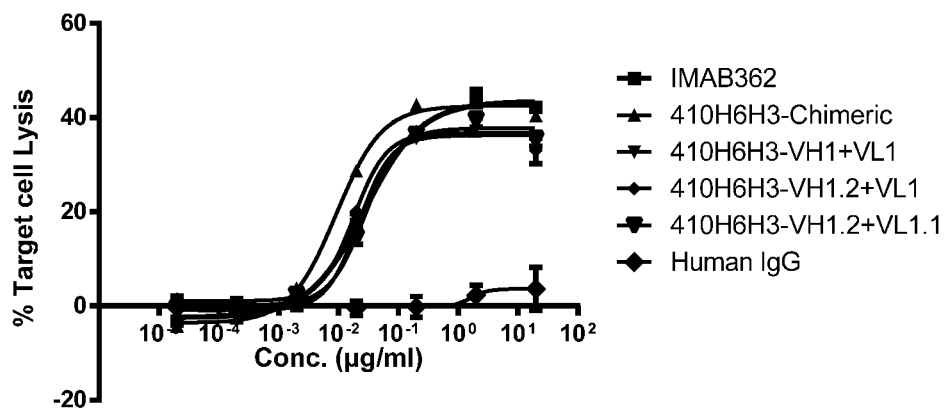
Figure 8H:
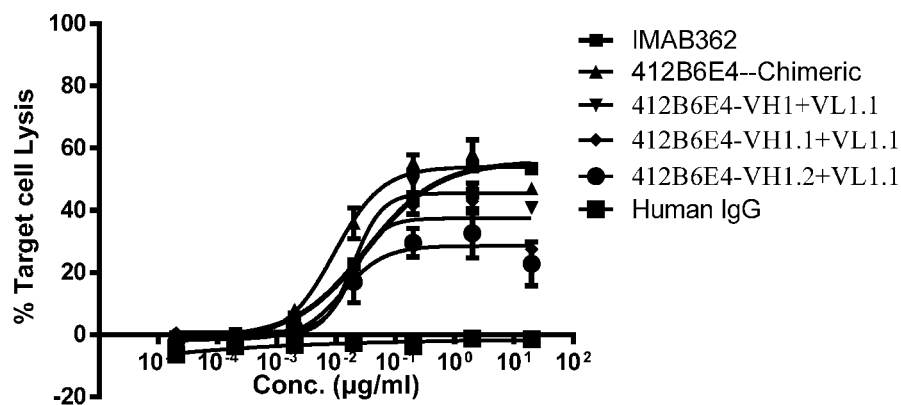
Figure 9A:
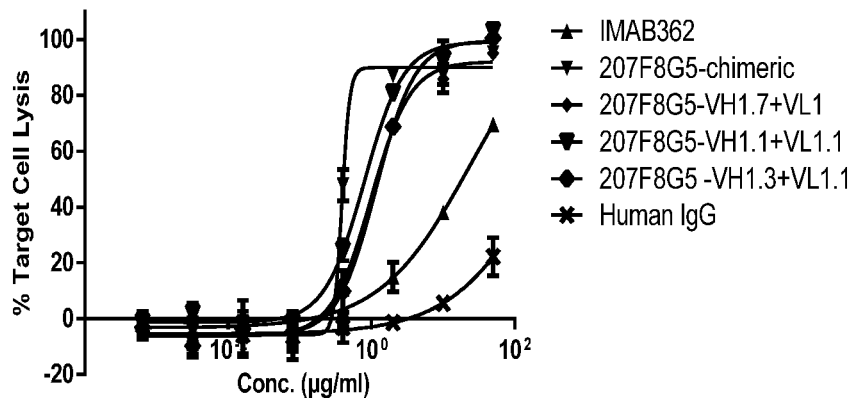
FIGS. 9A-9H. Humanized antibody Antibody-Dependent Cell-Mediated Cytotoxicity (ADCC) induction assay.
Figure 9B:
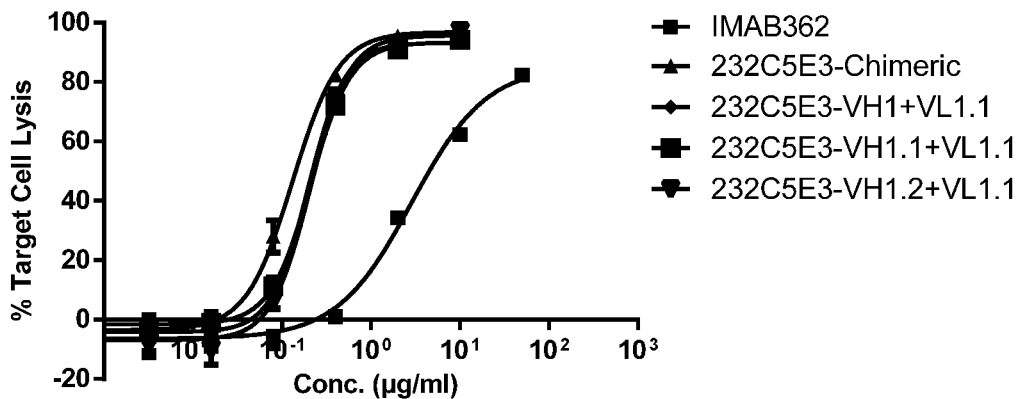
Figure 9C:
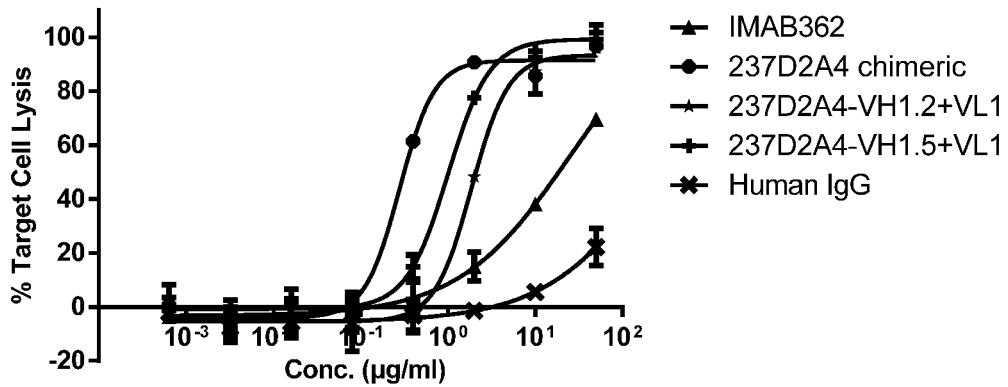
Figure 9D:
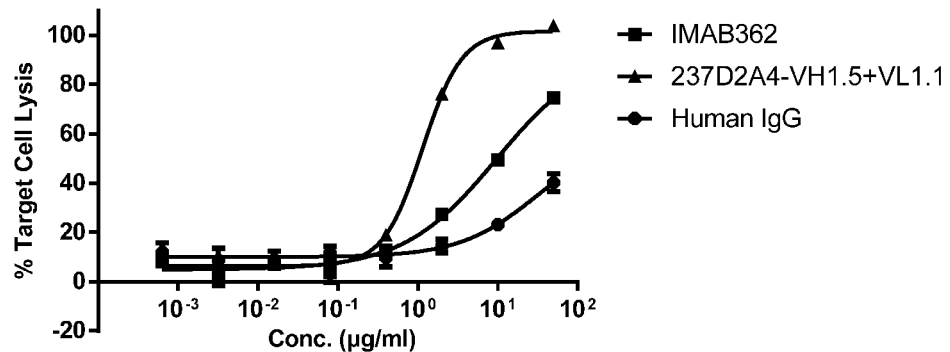
Figure 9E:
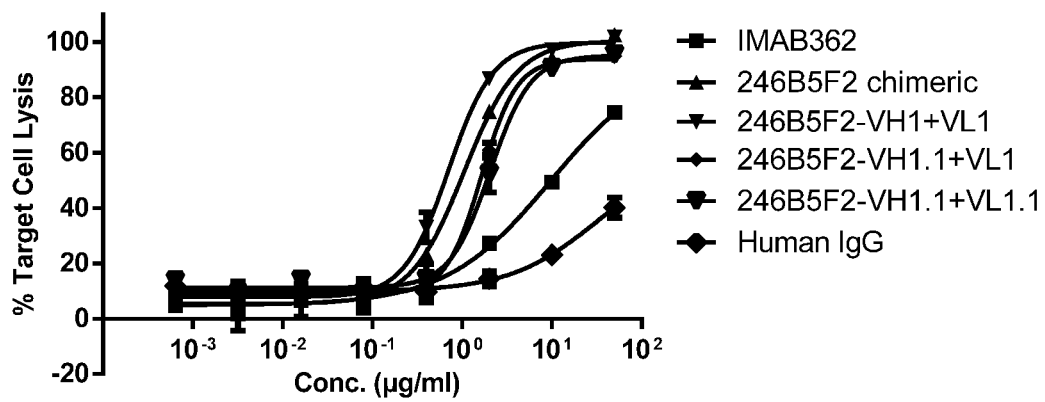
Figure 9F:
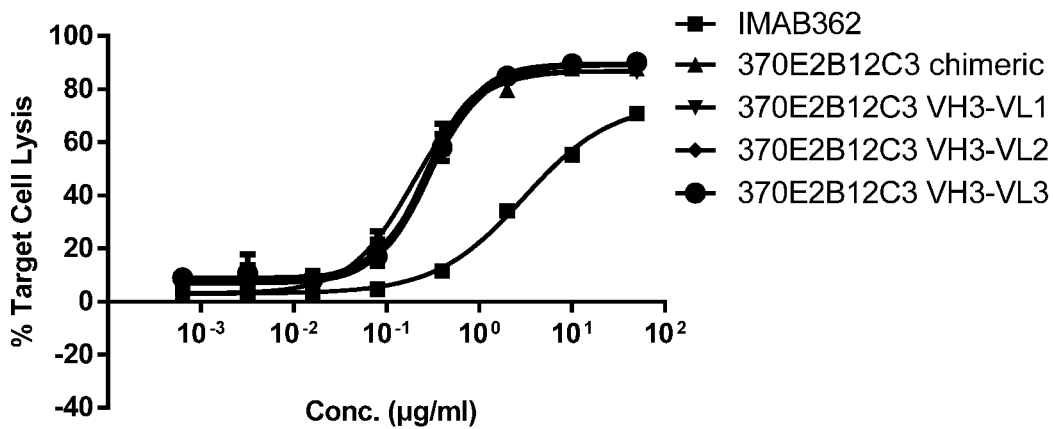
Figure 9G:
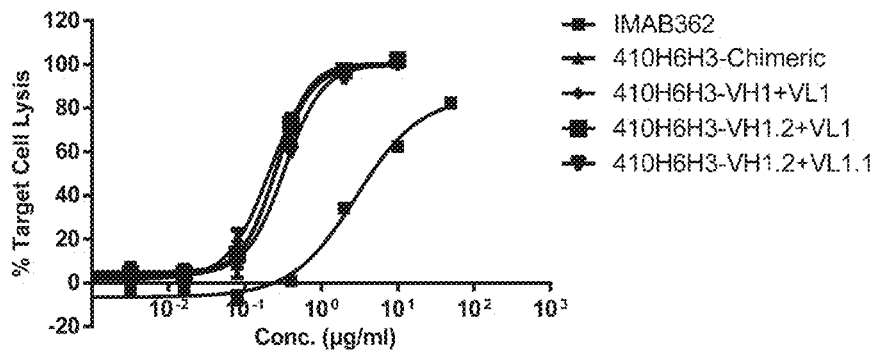
Figure 9H:
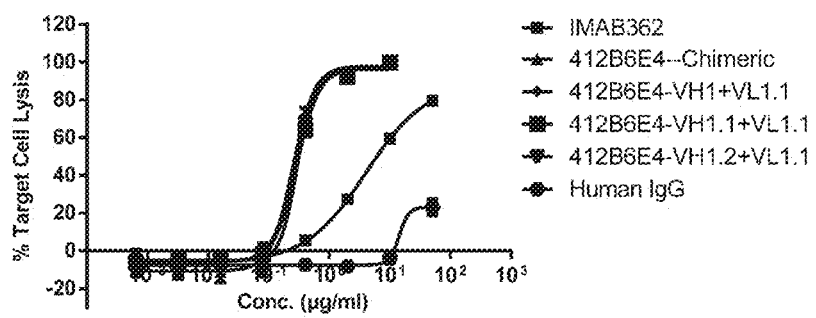

The CDC assay results were shown in FIGS. 5A to 5C and Table 9. Almost all antibodies of the disclosure showed lower EC50 and higher % relative activity than the benchmark IMAB362.

TABLE 9

Chimeric antibody's CDC activity

| Antibody ID | $EC_{50}$ (μg/ml) | % Relative activity | Antibody ID | $EC_{50}$ (μg/ml) | % Relative activity |
|---|---|---|---|---|---|
| 194D3B2 | 0.3404 | 793.18 | 185F2G12 | 0.101 | 2100 |
| 203A6C9 | 0.2605 | 1036.47 | 232C5E3 | 0.09938 | 2134.23 |
| 207F8G5 | 0.2071 | 1303.72 | 393C2C5A | 0.1046 | 2027.72 |
| 222B6G5 | 0.2047 | 1319.00 | 410H6H3 | 0.07559 | 2805.93 |
| 237D2A4 | 0.231 | 1168.83 | 412B6E4 | 0.1052 | 2016.16 |
| 246B5F2 | 0.2741 | 985.04 | 418D2F9 | 69.86 | 3.04 |
| 250F4G4 | 0.3087 | 874.64 | 419B5G9 | 0.1062 | 1997.18 |
| 252E7C9 | 0.2724 | 991.19 | 429H6C5 | 0.08738 | 2427.33 |
| 252F1B10 | 0.2882 | 936.85 | IMAB362 | 2.121 | 100 |
| 253E4F7 | 0.205 | 1317.07 | | | |
| IMAB362 | 2.7 | 100.00 | | | |
| 257B1G9 | 0.3579 | 642.36 | | | |
| 257G7B9 | 0.3024 | 760.25 | | | |
| 260G9E8 | 0.336 | 684.23 | | | |
| 262C7C10 | 0.3451 | 666.18 | | | |
| 265E6G2 | 0.4721 | 486.97 | | | |
| 273C10E5 | 0.2693 | 853.69 | | | |
| 370E2B12C3 | 0.1919 | 1198.02 | | | |
| IMAB362 | 2.3 | 100.00 | | | |
| Human IgG | 69.44 | 3.31 | | | |

Anti-Claudin18.2 Antibody Induced ADCC

The chimeric antibodies were further tested for their ADCC activities. For the assay procedure, the target cell line, CHO-K1-overexpressing human Claudin18.2 (GenScript, Cat.#. M00685), was cultured, harvested and seeded into 96 well plates, 10,000 cells/well. Serially diluted chimeric antibodies or in-house prepared IMAB362 analog as the positive control, were added to the plates and the plates were incubated at 37° C./5% $CO_2$ for 30 min.

TABLE 10

Chimeric antibody's ADCC activity

| Antibody ID | $EC_{50}$ (μg/ml) | % Relative activity | Antibody ID | $EC_{50}$ (μg/ml) | % Relative activity |
|---|---|---|---|---|---|
| 194D3B2 | 0.0291 | 83.64 | 273C10E5 | 0.02748 | 92.14 |
| 203A6C9 | 0.03667 | 66.38 | 370E2B12C3 | 0.03347 | 75.65 |
| 207F8G5 | 0.02137 | 113.90 | IMAB362 | 0.02532 | 100.00 |
| IMAB362 | 0.02434 | 100.00 | 185F2G12 | 0.008856 | 398.83 |
| 222B6G5 | 0.02763 | 130.91 | 232C5E3 | 0.007816 | 451.89 |
| 237D2A4 | 0.02138 | 169.18 | 393C2C5 | 0.01112 | 317.63 |
| 246B5F2 | 0.02297 | 157.47 | IMAB362 | 0.03532 | 100.00 |
| IMAB362 | 0.03617 | 100.00 | 410H6H3 | 0.003901 | 677.01 |
| 250F4G4 | 0.02813 | 108.96 | 412B6E4 | 0.004937 | 534.94 |
| 252E7C9 | 0.03107 | 98.65 | 418D2F9 | 0.1027 | 25.72 |
| 252F1B10 | 0.03569 | 85.88 | IMAB362 | 0.02641 | 100.00 |
| IMAB362 | 0.03065 | 100.00 | 260G9E8 | 0.02397 | 104.17 |
| 253E4F7 | 0.02249 | 137.75 | 262C7C10 | 0.02367 | 105.49 |
| 257B1G9 | 0.04545 | 68.16 | 265E6G2 | 0.03211 | 77.76 |
| 257G7B9 | 0.05555 | 55.77 | IMAB362 | 0.02497 | 100.00 |
| IMAB362 | 0.03098 | 100.00 | Human IgG | N/A | N/A |
| 419B5G9 | 0.007943 | 332.37 | | | |
| 429H6C5 | 0.01838 | 143.63 | | | |
| IMAB362 | 0.0264 | 100.00 | | | |

Human whole blood was collected, 1:1 v/v diluted with PBS, added with Lymphoprep, and centrifuged at 300 g at 4° C. for 25 min to separate PBMC layer. After washing with PBS twice, the freshly isolated human PBMCs (Peripheral Blood Mononuclear Cells) were used as the effector cells and added to the plates, ~50,000 cells per well, and incubated at the same condition for 6 hours. The assay plates were taken out and briefly centrifuged. The supernatants were collected and transferred to new plates for an LDH activity assay with Cytotoxicity Detection Kit (LDH) & 2000T (Roche 11644793001) as per manufacturer's instruction (Roche). The absorbance data were captured by FlexStation 3 and analyzed by GraphPad Prism 6.0.

The ADCC assay results were plotted in terms of percent target cell lysis versus candidate antibody concentration (FIGS. 6A-6J). The $EC_{50}$ values and % Relative activity (% Relative activity=($EC_{50}$ of the positive control/$EC_{50}$ of the sample)*100%) of the candidate chimeric antibodies were determined and summarized in Table 10. The antibodies of the present application showed comparable or higher ADCC activities as compared to IMAB362.

Example 4. Antibody Humanization and Characterization

Humanization Design for the Candidate Antibodies

Seven antibodies, 207F8G5, 232C5E3, 237D2A4, 246B5F2, 370E2B12C3, 410H6H3, and 412B6E4, were selected for humanization.

Based on antibody variable domain sequences, the CDRs, HV loops and FRs were analyzed and homology modeling was performed to obtain the modeled structure of the mouse antibody. Solvent accessible surface area of framework residues were calculated, and framework residues that are buried (i.e. with solvent accessible surface area of <15%) were identified. Up to three (3) human acceptors were selected for VH and VL that share the top sequence identities to the mouse counterparts, and the CDRs of the mouse antibody were grafted to the human acceptor frameworks. Canonical residues in framework region and residues on VH-VL interface that are believed to be important for the binding activity were back-mutated to murine residue.

For the lead 207F8G5, 9 heavy chain variable regions (VH1, VH1.1, VH1.2, VH1.3, VH1.4, VH1.5, VH1.6, VH1.7 and VH1.8) and 2 light chain variable regions (VL1 and VL1.1) were paired with each other for affinity ranking. The details of back mutation were list as below. VH1: CDR grafted heavy chain; VH1.1: VH1 with R38K, R72S, Y95F, R98T; VH1.2: VH1 with R38K, M48I, V68A, Y95F, R98T; VH1.3: VH1 with M48I, V68A, R72S, Y95F, R98T; VH1.4: VH1 with R38K, M48I, V68A, R72S, Y95F, R98T; VH1.5: VH1 with R38K, M70L, R72S, Y95F, R98T; VH1.6: VH1 with R38K, M48I, V68A, R72S, I76S, Y95F, R98T; VH1.7: VH1 with R38K, M70L, R72S, R98T; VH1.8: VH1 with V20M, R38K, M48I, V68A, M70L, R72S, I76S, Y95F, R98T; and VL1: CDR grafted light chain; VL1.1: VL1 with L15P, I21M, N22S.

For the lead 232C5E3, 5 heavy chain variable regions (VH1, VH1.1, VH1.2, VH1.3 and VH1.4) and 2 light chain variable regions (VL1 and VL1.1) were paired with each other for affinity ranking. The details of back mutation were list as below. VH1: CDR grafted heavy chain; VH1.1: VH1 with M48I, V68A, R72A, Y95F; VH1.2: VH1 with V37I, R38K, R72A, Y95F; VH1.3: VH1 with M48I, R72A, Y95F; VH1.4: VH1 with V37I, R38K, M48I, V68A, R72A, Y95F; and VL1: CDR grafted light chain; VL1.1: VL1 with I21M, N22S.

For the lead 237D2A4, 8 heavy chain variable regions (VH1, VH1.1, VH1.2, VH1.3, VH1.4, VH1.5, VH1.6 and VH1.7) and 2 light chain variable regions (VL1 and VL1.1)

were paired with each other for affinity ranking. The details of back mutation were list as below. VH1: CDR grafted heavy chain; VH1.1: VH1 with V71K, N76S, R97K; VH1.2: VH1 with V71K, F78V, S79F, R97K; VH1.3: VH1 with V71K, N76S, F78V, S79F, R97K; VH1.4: VH1 with I37V, V71K, N76S, R97K; VH1.5: VH1 with I37V, I48L, V67L, V71K, R97K; VH1.6: VH1 with I37V, I48L, V67L, V71K, N76S, R97K; VH1.7: VH1 with I37V, I48L, V67L, V71K, N76S, F78V, S79F, R97K; and VL1: CDR grafted light chain; VL1.1: VL1 with I21M, N22S.

For the lead 246B5F2, 5 heavy chain variable regions (VH1, VH1.1, VH1.2, VH1.3 and VH1.4) and 2 light chain variable regions (VL1 and VL1.1) were paired with each other for affinity ranking. The details of back mutation were list as below: VH1: CDR grafted heavy chain; VH1.1: VH1 with G44R, S49A, K98G; VH1.2: VH1 with S49A, S75A, K98G; VH1.3: VH1 with G44R, S49A, S75A, K98G; VH1.4: VH1 with Q3M, G44R, S49A, S75A, K98G; and VL1: CDR grafted light chain; VL1.1: VL1 with N22S, S69T.

For the lead 370E2B12C3, 3 heavy chain variable regions (VH1, VH2 and VH3) and 3 light chain variable regions (VL1 VL2 and VL3) were paired with each other for affinity ranking.

For the lead 410H6H3, 3 heavy chain variable regions (VH1, VH1.1 and VH1.2) and 2 light chain variable regions (VL1 and VL1.1) were paired with each other for affinity ranking. The details of back mutation were list as below: VH1: CDR grafted heavy chain; VH1.1: VH1 with S49A, Y80F; VH1.2: VH1 with L18R, S78T, Y80F; and VL1: CDR grafted light chain; VL1.1: VL1 with I21M, N22S, L52M.

For the lead 412B6E4, 3 heavy chain variable regions (VH1, VH1.1 and VH1.2) and 2 light chain variable regions (VL1 and VL1.1) were paired with each other for affinity ranking. The details of back mutation were list as below: VH1: CDR grafted heavy chain; VH1.1: VH1 with S49A, Y80F; VH1.2: VH1 with L18R, S78T, Y80F; and VL1: CDR grafted light chain; VL1.1: VL1 with I21M, N22S, L52M.

The amino acid sequence ID numbers of the humanized heavy/light chain variable regions are summarized in Table 1 and 2. DNA sequences encoding the humanized heavy chain variable region plus human IgG1 heavy chain constant region (amino acid set forth in SEQ ID NO.: 388), and DNA sequences encoding the humanized light chain variable region plus human kappa constant region (amino acid set forth in SEQ ID NO.: 389) were paired to express full-length antibodies for characterization, wherein the C-terminus of the heavy chain variable region was linked to the N-terminus of human IgG1 heavy chain constant region, and the C-terminus of the light chain variable region was linked to the N-terminus of human kappa constant region.

After initial screening of cell binding with transfected supernatants, the binding pattern of chimeric and up to 3 humanized antibodies on Claudin18.2 expressed on HEK293 cells were plotted with antibody in 3× serial dilutions, starting concentration of 45 µg/ml, following the protocol described in Example 3. The binding data of some representative antibodies were shown in FIG. 7A-7G and Table 11. Negative binding to Claudin18.1 was confirmed by FACS (data not shown).

TABLE 11

| Binding capacities of humanized antibodies to Claudin18.2-HEK293 cells | | | | | |
|---|---|---|---|---|---|
| | 207F8G5-Chimeric | 207F8G5-VH1.7 + VL1 | 207F8G5-VH1.1 + VL1.1 | 207F8G5-VH1.3 + VL1.1 | IMAB362 |
| $EC_{50}$ (µg/ml) | 0.1699 | 0.1451 | 0.1678 | 0.1429 | 0.08646 |
| Span | 11849 | 13833 | 14038 | 13815 | 6184 |
| | 232C5E3-Chimeric | 232C5E3-VL1.1 + VH1 | 232C5E3-VL1.1 + VH1.1 | 232C5E3-VL1.1 + VH1.2 | IMAB362 |
| $EC_{50}$ (µg/ml) | 0.317 | 0.3036 | 0.2243 | 0.2124 | 5.859 |
| Span | 69677 | 57959 | 54919 | 57896 | 38396 |
| | 237D2A4-Chimeric | 237D2A4-VH1.2 + VL1 | 237D2A4-VH1.5 + VL1 | 237D2A4-VH1.5 + VL1.1 | IMAB362 |
| $EC_{50}$ (µg/ml) | 0.0923 | 0.2606 | 0.2492 | 0.2176 | 0.08646 |
| Span | 14847 | 15731 | 15388 | 15515 | 6184 |
| | 246B5F2-Chimeric | 246B5F2-VH1 + VL1 | 246B5F2-VH1.1 + VL1 | 246B5F2-VH1.1 + VL1.1 | IMAB362 |
| $EC_{50}$ (µg/ml) | 0.1918 | 0.1598 | 0.1037 | 0.2826 | 0.08646 |
| Span | 12362 | 14192 | 10916 | 14691 | 6184 |
| | 370E2B12C3-chimeric | 370E2B12C3-VH3 + VL1 | 370E2B12C3-VH3 + VL2 | 370E2B12C3-VH3 + VL3 | IMAB362 |
| $EC_{50}$ (µg/ml) | 0.7719 | 0.8263 | 0.794 | 1.171 | 0.6322 |
| Span | 4570 | 4654 | 4300 | 5521 | 2562 |
| | 410H6H3-Chimeric | 410H6H3-VH1 + VL1 | 410H6H3-VH1.2 + VL1 | 410H6H3-VH1.2 + VL1.1 | IMAB362 |
| $EC_{50}$ (µg/ml) | 0.8426 | 0.3301 | 0.3724 | 0.5553 | 5.859 |
| Span | 79128 | 72092 | 72989 | 64530 | 38396 |

TABLE 11-continued

Binding capacities of humanized antibodies to Claudin18.2-HEK293 cells

|  | 412B6E4-Chimeric | 412B6E4-VH1 + VL1.1 | 412B6E4-VH1.1 + VL1.1 | 412B6E4-VH1.2 + VL1.1 | IMAB362 |
|---|---|---|---|---|---|
| $EC_{50}$ (μg/ml) | 0.5551 | 0.3733 | 0.5714 | 0.512 | 5.859 |
| Span | 87928 | 65871 | 71349 | 70339 | 38396 |

These humanized antibodies were further tested for the ADCC and CDC activities. For the ADCC assay, CHO-K1/CLDN18.2 cells (GenScript, Cat. No. M00685) were seeded in 96-well flat plates at a density of ~10,000 cells per well in assay buffer (Fetal Bovine Serum (Gibco, 10099-141) 1%, MEM-α (Gibco, 41061-029) 99%). Then seriablly diluted antibodies or assay buffer were added to the plates, the plates were incubated at room temperature for 0.5 h. NK92/CD16a-VV cells (NK92 (ATCC, Cat #CRL-2407) engineered to overexpress CD16a (158V) with plasmid provided by GenScript were added in the assay plates at a density of 10000 cells per well in assay buffer with rhIL-2 in the concentration of 200 IU/mL. After about 6 h incubation at 37° C. in a humidified 5% $CO_2$ incubator, the plates were taken out from the incubator and left still to reach the room temperature. Then, the assay plates were subject to 500 g centrifugation for 3 min and the supernatants were transferred to another 96-well assay plate. LDH Cytotoxicity Kit (Roche, Cat #11644793001) was used to detect LDH release, and data of some representative antibodies was shown in FIG. 8A-8H.

For the CDC assay, CHO-K1 overexpressing human Claudin18.2 (GenScript, Cat. No. M00685) at the logarithmic phase were trypsinized and seeded into 384-well plates at a density of ~5000 cells per well in assay buffer (Fetal Bovine Serum (Gibco 10099-141) 1%, MEM-α (Gibco 41061-029) 99%, Heparin (Sangon Biotech A603251-0001) 100 μg/ml) and incubated with antibodies of different concentrations. After about 0.5 h incubation at room temperature, pooled normal human serum (PNHS) at working concentration of 10% from healthy donors was diluted with assay buffer and added to the plate wells. The assay plates were incubated at 37° C. for about 4 h in a humidified 5% $CO_2$ incubator, and then the plates were taken out and tested for cell viability using CellTiter-Glo Kit (Promega, Cat #G7573). Data of some representative antibodies were shown in FIG. 9A-9H.

These humanized antibodies showed comparable Claudin18.2 binding capacities, ADCC and CDC activities in potency and/or efficacy to their parental chimeric antibodies.

Example 5. Preparation and Characterization of Chimeric Antigen Receptors

A nucleotide encoding a CAR backbone polypeptide comprising from the N-terminus to the C-terminus a CD8α hinge domain (SEQ ID NO: 292), a CD8α transmembrane domain (SEQ ID NO: 293), a CD137 costimulatory domain (SEQ ID NO: 294), and a CD3ζ intercellular signaling domain (SEQ ID NO: 296) was synthesized and cloned into a pre-modified lentiviral vector (pLSINK-BBzBB) downstream and operably linked to a constitutive hEF1α promoter, or cloned into a cloning vector (pT7-BBzBB) and linked to a T7 promoter for in vitro transcription. Multicloning sites (MCS) in the vector allowed insertion of a nucleic acid sequence comprising a Kozak sequence operably linked to a nucleic acid sequence encoding a CD8α signal peptide (SEQ ID NO: 291) fused to the N-terminus of a single chain variable fragment (scFv) and a linker (SEQ ID NO: 298) into the CAR backbone vector, upstream and operably linked to the CAR backbone sequence. The scFv is consisted of a linker (SEQ ID NO: 297) connected to C-terminus of a light chain variable region and N-terminus of a heavy chain variable region. The nucleic acid sequence encoding the anti-Claudin 18.2 scFv and the signal peptide and linker was chemically synthesized and cloned into the pT7-BBzBB via the MluI (5'-ACGCGT-3') and SpeI (5'-ACTAGT-3') or pLSINK-BBzBB CAR backbone via the EcoRI (5'-GAATTC-3') and SpeI (5'-ACTAGT-3') restriction sites by molecular cloning techniques known in the art. The amino acid sequence ID numbers of the CAR and the corresponding heavy chain variable region, light chain variable region and scfv were summarized in Table 3.

The RNAs of the CAR constructs were prepared by in vitro transcription using mMESSAGE/mMACHINE T7 Kit (Thermo Fisher AM1344 and AM1350). In specific, the purified plasmids were proceeded to in vitro transcription reactions and incubation according to the instructions of the Kit. The transcribed RNAs (IVT-RNAs) were then purified using RNeasy Mini kit (QIAGEN, Cat #75144). Finally, the WT-RNAs were liquated at 10 μL/vial, stored at −80° C. immediately or used directly for CAR-T preparation.

The lentivirus packaging plasmid mixture comprising pMDLg.pRRE (Addgene #12251), pRSV-REV(Addgene #12253) and pMD2. G (Addgene #12259) was pre-mixed with the vectors expressing CAR constructs at a pre-optimized ratio with polyetherimide (PEI), then incubated at 25° C. for 5 min. Then HEK293 cells were added into the transfection mix. Afterwards, cells were incubated overnight in a cell incubator with 5% $CO_2$ at 37° C. The supernatants were collected after centrifuged at 4° C. and 500 g for 10 min, and filtered through a 0.45 μm PES filter followed by ultra-centrifugation for lentivirus concentration. Then the supernatants were carefully discarded and the lentivirus pellets were rinsed cautiously with pre-chilled DPBS. The lentiviruses were liquated properly, and stored at −80° C. The lentivirus titer was determined by p24 based on HTRF kit developed by GenScript.

PBMC Preparation

Leukocytes were collected from healthy donors by apheresis, and cell concentration was adjusted to 5×10⁶ cells/mL in R10 medium. Leukocytes were then mixed with 0.9% NaCl solution at 1:1 (v/v) ratio. 3 mL lymphoprep medium was added to a 15 mL centrifuge tube, and 6 ml of diluted lymphocyte mix was slowly layered on top of the lymphoprep medium. The lymphocyte mix was centrifuged at 800 g for 30 min without brakes at 20° C. Lymphocyte buffy coat was then collected with a 200 μL pipette. The harvested fraction was diluted at least 6 folds with 0.9% NaCl or R10 to reduce solution density. The harvested fraction was then centrifuged at 250 g for 10 minutes at 20° C. The supernatant was aspirated completely, and 10 mL of R10 was added to the cell pellet to resuspend the cell pellet. The mixture was further centrifuged at 250 g for 10 min at 20° C. The supernatant was again aspirated. 2 mL of 37° C. pre-warmed R10 with 300 IU/mL IL-2 was added to the cell pellet, and the cell pellet was re-suspended softly. The cell number was determined following Trypan Blue staining, and this PBMC sample was ready for later experiments.

T Cell Purification

Human T cells were purified from PBMCs using Miltenyi Pan T cell isolation kit (Cat #130-096-535), following the manufacturer's protocol as described below. Cell number was first determined and the cell suspension was centrifuged at 300 g for 10 min. The supernatant was then aspirated completely, and the cell pellets were re-suspended in 40 μL buffer per $10^7$ total cells. 10 μL of Pan T Cell Biotin-Antibody Cocktail was added per $10^7$ total cells, mixed thoroughly and incubated for about 5 min in the refrigerator (2-8° C.). 30 μL of buffer was then added per $10^7$ cells. 20 μL of Pan T Cell MicroBead Cocktail was added per $10^7$ cells. The cell suspension mixture was mixed well and incubated for an additional 10 min in the refrigerator (2-8° C.). A minimum of 500 μL is required for magnetic separation. For magnetic separation, an LS column was placed in the magnetic field of a suitable MACS Separator. The column was prepared by rinsing with 3 mL of buffer. The cell suspension was then applied onto the column, and flow-through containing the unlabeled cells was collected, which represented the enriched T cell fractions. Additional T cells were collected by washing the column with 3 mL of buffer and collecting unlabeled cells that passed through. These unlabeled cells again represented the enriched T cells, and were combined with the flow-through from previous step. The pooled enriched T cells were then centrifuged and re-suspended in R10+300 IU/mL IL-2.

The prepared T cells were subsequently pre-activated for 48-96 hours with human T cell activation/expansion kit (Miltenyi #130-091-441) according to manufacturer's protocol in which anti-CD3/CD28 MACSiBead particles were added at a bead-to-cell ratio of 1:2.

Target Cell line Construction

Target cells were developed in house based on gastric cancer cell lines including KATOIII (ATCC #HTB-103), NUGC4 (JCRB0834), MKN45 (JCRB0254) and a pancreatic cancer cell line PANC1 (ATCC #CRL-1469TM). KatoIII.18.2.Luc cell line was developed to co-express human Claudin 18.2 ORF (NM 001002026.2) and firefly luciferase using a 2A peptide. KatoIII.18.1.Luc cell line was developed to co-express human Claudin 18.1 ORF (NM 016369.3) and firefly luciferase using a 2A peptide. KatoIII-.Luc cell line was developed to over-express firefly luciferase alone. The expression of the target gene was validated by semi-quantitative PCR.

Expression of Engineered CAR-T Cells

The pre-activated T cells were electroporated with CAR IVT-RNAs. Pre-activated T cells were harvested by centrifugation at 300 g for 10 minutes at room temperature. After completely removing supernatant, cell pellets were resuspended in Celetrix 103 buffer, and cell concentration was assessed by trypan blue staining and aliquoted at 4-6 million human T cell per 120 μL. The electroporation mix was prepared by adding 10 μg CAR-mRNA to each aliquots of pre-activated T cells. Electroporation was then performed at a pre-optimized voltage and pulse (820V/20 ms) by using Celetrix electroporation apparatus. Immediately after the electroporation process, cells were transferred to a new pre-heated medium, and cultured overnight at a humidified 37° C. with 5% $CO_2$ incubator until analysis.

On day 6 to day 9 post-transduction, transduced T cells were harvested. CAR expression levels were assessed by flow cytometry. Briefly, $1\times10^6$ electroporated T cells were collected from each group, then incubated with FITC labeled goat anti-mouse Fab antibodies (Abcam, cat No. #ab98658) for 0.5-1 h at 4° C. Upon completion of incubation, cells were harvested and washed with DPBS, then centrifuged at 300 g for 10 min at 20° C. The expression level of each prepared CAR-T cell was read on Attune NxT Flow Cytometer (Thermo Fisher), and data were shown in Table 12. UnT represented T cells un-transduced with CAR, and 175DX represented CAR containing scFv of IMAB362 (SEQ ID NO: 336) used as a positive control.

TABLE 12

CAR expression level

| CAR-T Code/UnT | CAR expression % | CAR Code | CAR expression % | CAR Code | CAR expression % |
|---|---|---|---|---|---|
| UnT | 2.71% | UnT | 1.63% | UnT | 1.65% |
| C182001 | 20.30% | C182003 | 88.30% | C182003 | 95.60% |
| C182002 | 97.30% | C182006 | 76.60% | C182014 | 57.60% |
| C182003 | 98.10% | C182007 | 72.90% | C182015 | 94.90% |
| C182004 | 96.30% | C182008 | 39.10% | C182016 | 94.20% |
| C182005 | 97.40% | C182009 | 15.70% | C182017 | 5.33% |
| 175DX | 97% | C182010 | 10.70% | C182018 | 95.90% |
|  |  | C182011 | 72.90% | C182019 | 91.80% |
|  |  | C182012 | 22.70% | C182020 | 94.00% |
|  |  | C182013 | 3.15% | C182021 | 90.90% |
|  |  | 175DX | 63.10% | 175DX | 77.6% |
| UnT | 1.69% | UnT | 1.69% |  |  |
| C182003 | 92.00% | C182003 | 96.70% |  |  |
| C182022 | 86% | C182030 | 95.50% |  |  |
| C182023 | 83.80% | C182031 | 16.30% |  |  |
| C182024 | 89.40% | C182032 | 10.40% |  |  |
| C182025 | 90.50% | C182033 | 84.30% |  |  |
| C182026 | 94.00% | C182034 | 80.20% |  |  |
| C182027 | 8.75% | C182035 | 96.10% |  |  |
| C182028 | 89.30% | C182036 | 9.79% |  |  |
| C182029 | 48.80% | C182037 | 52.60% |  |  |
| 175DX | 81.80% | 175DX | 93% |  |  |

Cytotoxicity Assay

Cytotoxicity assay was performed after CAR-T cells were co-incubated with tumor cells at 20:1, 5:1 and 1:1 effector (CAR-T) to target cell ratios (E:T) for 20-24 hours. To assay the cytotoxicity of CAR-T on tumor cells, One-glo luminescent luciferase assay reagents (Promega #E6110) were prepared according to manufacturer's protocol, and added to the co-cultured cells to detect the luciferase activity in the well which was correlated to the number of viable target cells in the well.

The specific cytotoxicity was calculated by the formula: Specific Cytotoxicity %=100%×(1−($RLU_{sample}$−$RLU_{min}$)/($RLU_{UnT}$−$RLU_{min}$)). $RLU_{sample}$ represented for the luciferase activity as measured in the well with CAR-T cells having specific CARs of the invention. $RLU_{min}$ referred to the luciferase activity as determined in the well added with Triton X-100 at a final concentration of 1% when the cytotoxicity assay was initiated, and $RLU_{UnT}$ referred to the luciferase activity as determined in the well with T cells un-transduced with CARs.

Figure 10:
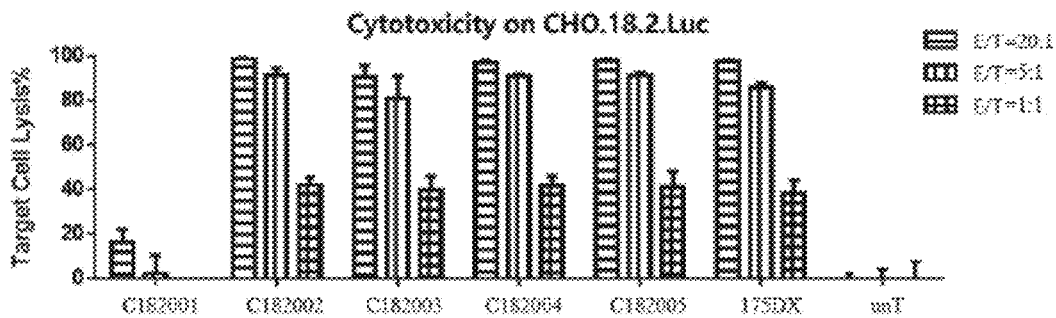
FIG. 10 shows results of an in vitro cytotoxicity assay of T cells expressing exemplary CARs against CHO.18.2.Luc cells or CHO.18.1.Luc cells.
Figure 10:
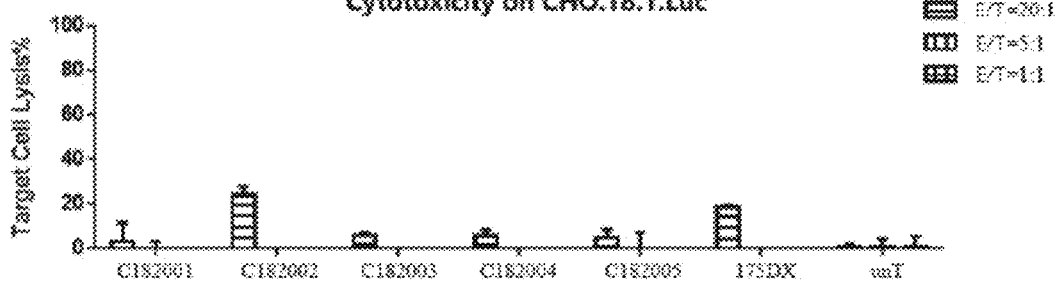

As shown in FIG. 10, T cells with the C182002 to C182005 CARs induced potent killing of CHO.18.2.Luc cells over-expressing human Claudin 18.2, at comparable cytotoxic levels as compared to T cells with 175DX. T cells with CAR C182001 induced lower cytotoxicity level on CHO.18.2.Luc cells, may be due to the relatively low CAR expression level (20.3% as compared to above 90% by other clones). T cells with these anti-Claudin18.2 CARs induced almost no killing effect on human Claudin 18.1 overexpressing cells (CHO.18.1.Luc).

Figure 11:
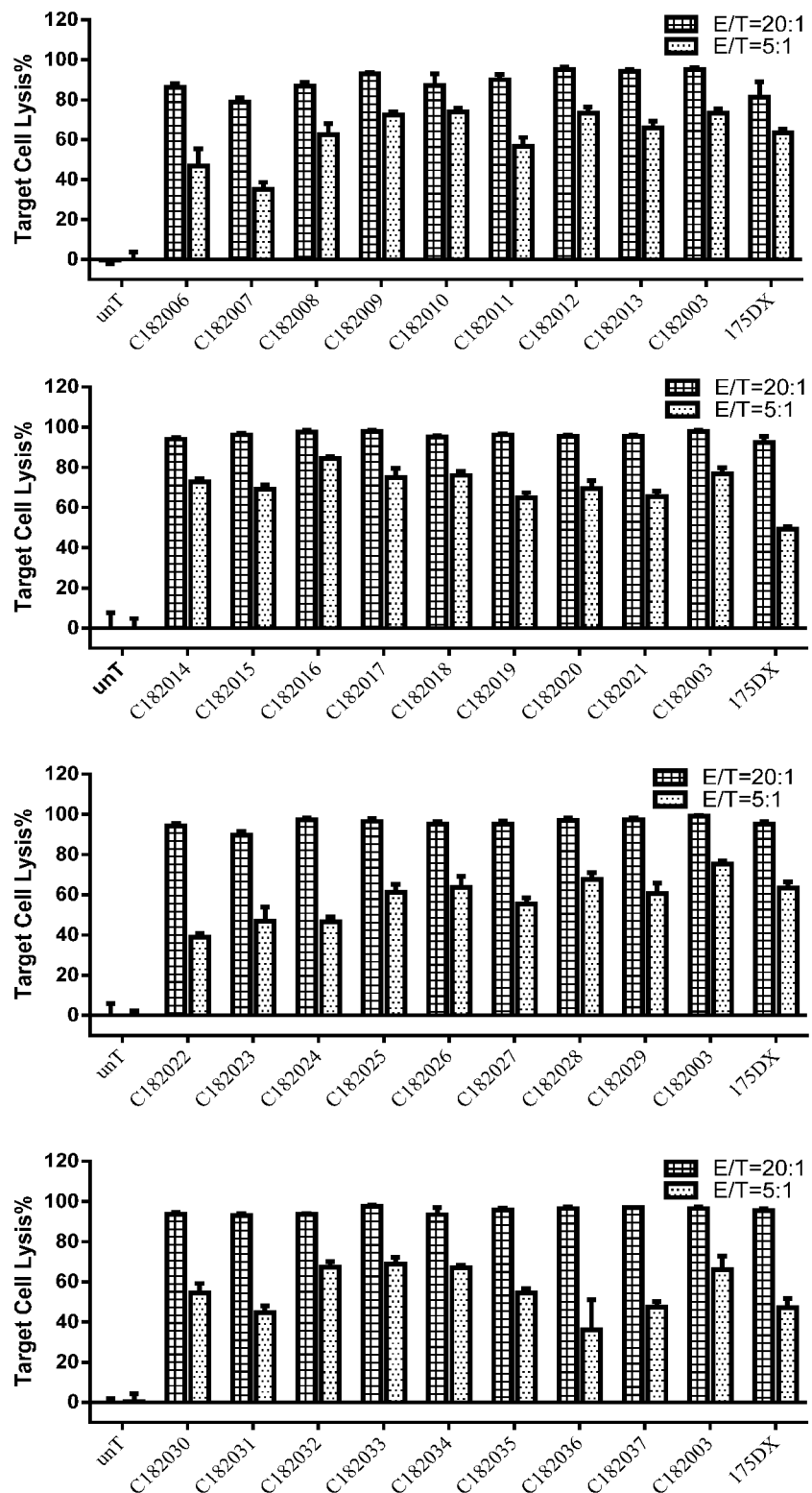
FIG. 11 shows results of an in vitro cytotoxicity assay of T cells expressing exemplary CARs against Claudin 18.2 positive cell lines.

Further, as illustrated in FIG. 11, T cells with anti-Claudin 18.2 CARs C182006 to C182037 showed potent cytotoxicity on KatoIII.18.2.Luc cells, and stronger cytotoxicity effects on KatoIII.18.2.Luc cells were detected at a higher E/T ratio. While E/T ratio at 20:1 seemed to be a saturated condition for the cytotoxicity assays, T cells with several CARs at the lower E/T ratio (5:1) induced significantly higher levels of cytotoxicity on KatoIII.18.2.Luc than those with 175DX, including T cells with CARs C182003, C182014 to C182021, and C182032 to C182034 (tested by Two-way ANOVA). T cells with other CARs induced cytotoxicities at comparable levels as compared to those with 175DX.

Figure 12:
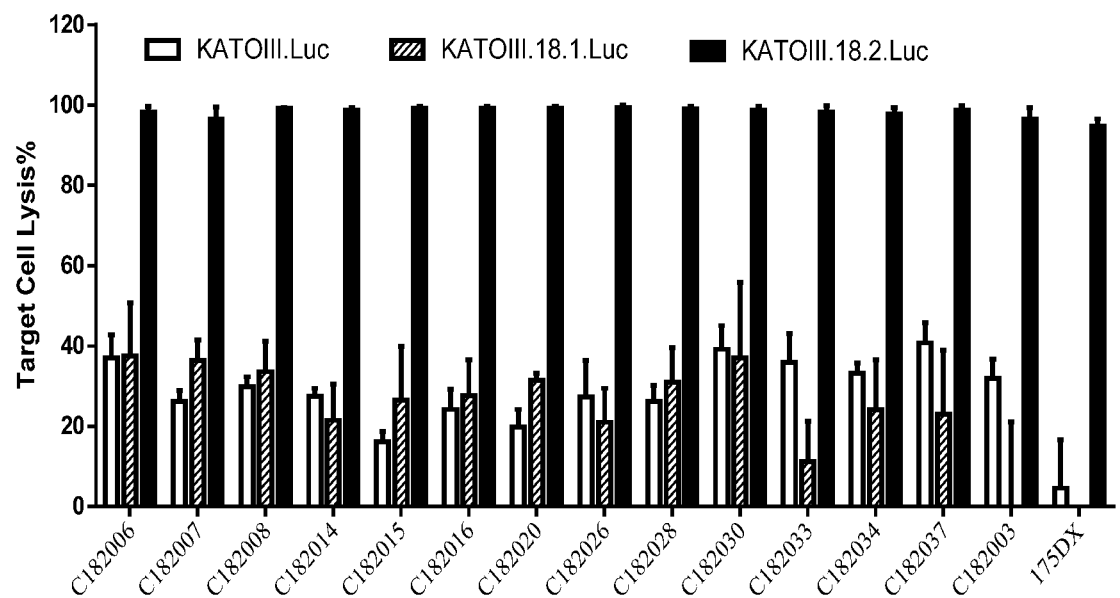
FIG. 12 shows results of an in vitro cytotoxicity assay of T cells expressing exemplary CARs against KATOIII.Luc cells, KATOIII.18.1.Luc cells, or KATOIII.18.2.Luc cells.

The cytotoxicity of anti-Claudin 18.2 CAR-T cells were also evaluated on KATOIII.18.2.Luc, KATOIII.18.1.Luc, and KATOIII.Luc cell lines, respectively, at an E/T ratio of 5:1. As shown in FIG. 12, T cells with the anti-Claudin18.2 CARs of the invention induced similar levels of cytotoxicity on KATOIII.18.2.Luc cells as compared to those with 175DX, but significantly stronger cytotoxic effects on KATOIII.18.1.Luc and KATOIII.Luc cells than those with 175DX. The results suggested that the CARs of the invention may be more sensitive to cells with low human Claudin 18.2 expression levels. More importantly, cytotoxicity on KATOIII.Luc was not stronger than that on KATOIII.18.1.Luc cells, suggesting such cytotoxicity effects were human Claudin 18.2 specific.

SEQUENCES

Some sequences of the disclosure are listed below, with CDRs underlined.

```
GROUP 1
260G9E8-VH
                                              (SEQ ID NO: 1)
QADLQQSGAELVRSGASVKMSCKASGYTFASHNMHWVKQTPGQGLEWIGYIYPGNGGTKYNQKFT
GKATLTADTSSSTAYMQITSLTSEDSAVYFCARDYYGNSFAYWGQGTLVTVSA

260G9E8-VL
                                              (SEQ ID NO: 2)
DIVMTQSPSSLTEKAGEKVSMRCKSSQSLLNSGNQKNYLTWYQQKPGQPPKLLIYWASTRESGVPDR
FTGSGSGTDFTLTISSVQADDLAVYYCQNDYMFPFTFGAGTKLELK

252F1B10-VH
                                              (SEQ ID NO: 3)
QAYLQQSGAELVRSGASVKMSCKASGYTFTSHNMHWVKQTPGQGLEWIGYIYPGNGGTNYNQKFK
GKATLTADTSSSTAYMQINSLTSEDSAVYFCTRDYYGNSFAYWGQGTLVTVSA

252F1B10-VL
                                              (SEQ ID NO: 4)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNDYRYPFTFGAGTKLELK

257B1G9-VH
                                              (SEQ ID NO: 5)
QAYLQQSGAELVRSGASVKMSCKASGYTFTSHNMHWVKQTPGQGLEWIGYIYPGNGGTNYNQKFK
GKATLTADTSSSTAYMQISSLTSEDSAVYFCTRDYYGNSFAYWGQGTLVTVSA

257B1G9-VL
                                              (SEQ ID NO: 6)
DIVMTQSPSSLTERAGERVSMSCKSSQSLFNSGNQKNYLTWYQQKPGQPPKLLIYWASTRESGVPDRF
TGSGSGTDFTLTISSVQAEDLAVYYCQNDYRYPFTFGAGTKLELK

265E6G2-VH
                                              (SEQ ID NO: 7)
QAYLQQSGAELVRSGASVKMSCKASGYTFTSYNMHWVKQTPGQGLEWIGYIYPGNGGTNYNQKFK
GKATLTADTSSSTAYMQISSLTSEDSAVYFCARDYYGNSFAYWGQGTLVTVSA

265E6G2-VL
                                              (SEQ ID NO: 8)
DLVMTQSPSSLTVTAGEKVTMSCKSSQSLLNSGNQKNYLTWYQQKPGQPPKLLIYWASTRESGVPDR
FTGSGSGTDFTLTISNIQAEDLAVYYCQNDYSYPLPFGAGTKLELR

250F4G4-VH
                                              (SEQ ID NO: 9)
QAYLQQSGAELVRSGASVKMSCKASGYTFTSHNMHWVKQTPGQGLEWIGYIYPGNGRTNYNQKFK
GKATLTADTSSSTAYMQISSLTSEDSAVYFCTRDYYGNSFAYWGQGTLVTVSA

250F4G4-VL
                                              (SEQ ID NO: 10)
DIVMTQSPSSLTEKVGERVSMSCKSSQSLFNSGNQKNYLTWYQQKPGQPPKLLIYWASTRESGVPDRF
TGSGSGTDFTLTISSVQAEDLAVYYCQNDYWYPFTFGAGTKLELK

262C7C10-VH
                                              (SEQ ID NO: 11)
QAYLQQSGAELVRSGASVKMSCKASGYTFTNYNIHWVKQTPGQGLEWIGYIYPGNGGNYYNQKFK
GKATLTADTSSITAYMQISSLTSEDSAVYFCARDYYGNSFAYWGQGTLVTVSA
```

-continued

262C7C10-VL (SEQ ID NO: 12)

DIVMTQSPSSLTVTAGEKVTMNCKSSQSLLNSGNQKNYLTWYQQKPGQPPKLLIYWASTRESGVPDR
FTGSGSGTDFTLTISSVQAEDLAIYYCQNDYYYPLTFGAGTKLELK

232C5E3-VH (SEQ ID NO: 13)

QAYLQQSGAELVRSGASVKMSCKASGYTFTSHNIHWIKQTPGKGLEWIGYIYPGNGGTNYNQKFKA
KATLTADTSSSTAYMQISSLTSEDSAVYFCARDYYGNSFAYWGQGTLVTVSA

232C5E3-VL (SEQ ID NO: 14)

DIMMTQSPSSLTETAGEKVSMSCKSSQSLLNSGNQKNYLTWYQQKPGQPPKLLIYWASTRESGVPDR
FSGSGSGTDFTLTISSVQAEDLAVYYCQNGYRFPFTFGAGTKLELK

Humanized 232C5E3-VH1

(SEQ ID NO: 348)

QVQLVQSGAEVKKPGASVKVSCKASGYTFTSHNIHWVRQAPGQRLEWMGYIYPGNGGTNYNQKFK
ARVTITRDTSASTAYMELSSLRSEDTAVYYCARDYYGNSFAYWGQGTLVTVSS

Humanized 232C5E3-VH1.1

(SEQ ID NO: 349)

QVQLVQSGAEVKKPGASVKVSCKASGYTFTSHNIHWVRQAPGQRLEWIGYIYPGNGGTNYNQKFKA
RATITADTSASTAYMELSSLRSEDTAVYFCARDYYGNSFAYWGQGTLVTVSS

Humanized 232C5E3-VH1.2

(SEQ ID NO: 350)

QVQLVQSGAEVKKPGASVKVSCKASGYTFTSHNIHWIKQAPGQRLEWMGYIYPGNGGTNYNQKFKA
RVTITADTSASTAYMELSSLRSEDTAVYFCARDYYGNSFAYWGQGTLVTVSS

Humanized 232C5E3-VH1.3

(SEQ ID NO: 351)

QVQLVQSGAEVKKPGASVKVSCKASGYTFTSHNIHWVRQAPGQRLEWIGYIYPGNGGTNYNQKFKA
RVTITADTSASTAYMELSSLRSEDTAVYFCARDYYGNSFAYWGQGTLVTVSS

Humanized 232C5E3-VH1.4

(SEQ ID NO: 352)

QVQLVQSGAEVKKPGASVKVSCKASGYTFTSHNIHWIKQAPGQRLEWIGYIYPGNGGTNYNQKFKA
RATITADTSASTAYMELSSLRSEDTAVYFCARDYYGNSFAYWGQGTLVTVSS

Humanized 232C5E3-VL1

(SEQ ID NO: 353)

DIVMTQSPDSLAVSLGERATINCKSSQSLLNSGNQKNYLTWYQQKPGQPPKLLIYWASTRESGVPDRF
SGSGSGTDFTLTISSLQAEDVAVYYCQNGYRFPFTFGQGTKLEIK

Humanized 232C5E3-VL1.1

(SEQ ID NO: 354)

DIVMTQSPDSLAVSLGERATMSCKSSQSLLNSGNQKNYLTWYQQKPGQPPKLLIYWASTRESGVPDR
FSGSGSGTDFTLTISSLQAEDVAVYYCQNGYRFPFTFGQGTKLEIK

252E7C9-VH (SEQ ID NO: 15)

QTYLQQSGAELVRSGASVKMSCRTSGYSFTSHNMHWVKQTPGQGLEWIGYIYPGNGGSYYNQKFKG
KAILTADTSSSTAYMQISSLTSEDSAVYFCTRDYYGNSFVYWGQGTLVTVSA

252E7C9-VL (SEQ ID NO: 16)

DVVMTQSPSSLTEKTGEKVSMSCKSSQSLLNSGNQKNYLTWYQQKPGQPPKLLIYWASTRESGVPDR
FTGSGSGTDFTLTISSLQTEDLAIYYCQNNFRYPFTFGAGTKLELK

257G7B9-VH (SEQ ID NO: 17)

QAYLQQSGAELVRSGASVKMSCKASGYTFTSHNLHWVKQTPGQGLEWIGYIYPGNGNTNYNQKFK
GKATLTADTSSSTAYMQISSLTSEDSAVYFCTRDYYGNSFAYWGQGTLVTVSA

257G7B9-VL (SEQ ID NO: 18)

DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNNYWFPFTFGAGTKLELK

241H10A1-VH (SEQ ID NO: 19)

QVQLQQSGAELVKPGASVKLSCKASGYTFTSFGINWLRQRPEQGLEWIGWIFPGDGNSKYNENFKGK
ATLTTDKSSSTAYMQVTRLTSEDSAVYFCARFYYGNSFANWGQGTLVTVSA

241H10A1-VL (SEQ ID NO: 20)

DIVMTQSPSSLTVTAGEKVTMSCKSSQSLLNSGNQKNYLTWYQQKPGQPPKLLIYWAATRESGVPDR
FTGSGSGTDFTLTISSVQAEDLAVYYCQNDYFYPFTFGGGTKLELK

```
273C10E5-VH
                                               (SEQ ID NO: 21)
QVQLQQSGAELVKPGASVKLSCKASGYTFTSFGINWLRQRPEQGLEWIGWIFPGDGNSKYNENFKGK
ATLTTDKSSSTAYMQVTRLTSEDSAVYFCARFYYGNSFANWGQGTLVTVSA

273C10E5-VL
                                               (SEQ ID NO: 22)
DIVMTQSPSSLTVTAGEKVTMSCKSSQSLLNSGNQKNYLTWYQQKPGQPPKLLIYWAATRESGVPDR
FAGSGSGTDFTLTISSVQAEDLAVYYCQNDYFYPFTFGAGTKLELK

240F8G2-VH
                                               (SEQ ID NO: 281)
QAYLQQSGAELVRSGASVKMSCKASGYTFTNYNIHWVKQTPGQGLEWIGYIYPGNGGNYYNQKFK
GKATLTADTSSSTAYMQISSLTSEDSAVYFCARDYYGNSFAYWGQGTLVTVSA

240F8G2-VL
                                               (SEQ ID NO: 282)
DIVVTQSPSSLTVTAGEKVTMNCKSSQSLLNSGNQKNYLTWYQQKPGQPPKLLIYWASTRESGVPDR
FTGSGSGTDFTLTISSVQAEDLAIYYCQNDYYYPLTFGAGTKLELK

234A10F7-VH
                                               (SEQ ID NO: 495)
QVQLQQSGAELVKPGASVKLSCKASGYTFTSFGINWLRQRPEQGLEWIGWIFPGDGNSKYNENFKGK
ATLTTDKSSSTAYMQLTRLTSEDSAVYFCARFYYGNSFAYWGQGTLVTVSA

234A10F7-VL
                                               (SEQ ID NO: 496)
DIVMTQSPSSLTVTTGQKVTMSCKSSQSLLNSGNQKNYLTWYQQKPGQPPKLLIYWAATRESGVPDR
FTGSGSGTDFTLTISSVQAEDLAVYYCQNDYFYPFTFGAGTKLELK

240D6F5-VH
                                               (SEQ ID NO: 497)
QAYLQQSGAELVRSGASVKMSCKASGYTFTSHNMHWVKQTPGQGLEWIGYIYPGNGGTNYNQKFK
GKATLTADPSSSTAYMQINSLTSEDSAVYFCTRDYYGNSFAYWGQGTLVTVSA

240D6F5-VL
                                               (SEQ ID NO: 498)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNDYRYPFTFGAGTKLELK

242H12D6-VH
                                               (SEQ ID NO: 499)
QAYLQQSGAELVRSGASVKMSCKASGYTFTSHNMHWVKQTPGQGLEWIGYIYPGNGGTNYNQKFK
GKATLTADTSSSTAYMQINSLTSEDSAVYFCTRDYYGNSFAYWGQGTLVTVSA

242H12D6-VL
                                               (SEQ ID NO: 500)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNDYRYPFTFGAGTKLELK

243B4F2-VH
                                               (SEQ ID NO: 501)
QAYLQQSGAELVRSGASVKMSCKASGYTFTSHNLHWVKQTPGQGLEWIGYIYPGNGNTNYNQKFK
GKATLTADTSSSTAYMQISSLTSEDSAVYFCTRDYYGNSFAYWGQGTLVTVSA

243B4F2-VL
                                               (SEQ ID NO: 502)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNNYWFPFTFGAGTKLELK

243B4F7-VH
                                               (SEQ ID NO: 503)
QAYLQQSGAELVRSGASVKMSCKASGYTFTSHNLHWVKQTPGQGLEWIGYIYPGNGNTNYNQKFK
GKATLTADTSSSTAYMQISSLTSEDSAVYFCTRDYYGNSFAYWGQGTLVTVSA

243B4F7-VL
                                               (SEQ ID NO: 504)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNNYWFPFTFGAGTKLELK

243F6D2-VH
                                               (SEQ ID NO: 505)
QAYLQQSGAELVRSGASVKMSCRASGYTFTSHNMHWVKQTPGQGLEWIGYIYPGNGGTYYNQKFK
GKATLTADTSSSTAYMQISSLTSEDSAVYFCARDYYGNSFVYWGQGTLVTVSA

243F6D2-VL
                                               (SEQ ID NO: 506)
DVVMTQSPSSLTEKTGEKVSMSCKSSQSLLNSGNQKNYLTWYQQKPGQPPKLLIYWASTRESGVPDR
FTGSGSGTDFTLTISSLQTEDLAVYYCQNNYRYPFTFGAGTKLELK
```

-continued

250F4G1-VH (SEQ ID NO: 507)

QAYLQQSGAELVRSGASVKMSCKASGYTFTSHNMHWVKQTPGQGLEWIGYIYPGNGRTNYNQKFK
GKATLTADTSSSTAYMQISSLTSEDSAVYFCTRDYYGNSFAYWGQGTLVTVSA

250F4G1-VL (SEQ ID NO: 508)

DIVMTQSPSSLTEKVGERVSMSCKSSQSLFNSGNQKNYLTWYQQKPGQPPKLLIYWASTRESGVPDRF
TGSGSGTDFTLTISSVQAEDLAVYYCQNDYWYPFTFGAGTKLELK

257F1E11-VH (SEQ ID NO: 509)

QAYLQQSGAELVRSGASVKMSCKASGYTFTSHNIHWVKQTPRQGLEWIGYIYPGNGGTNYNQKFKG
KATLTADTSSSTAYMQISSLTSEDSAVYFCTRDYYGNSFAYWGQGTLVTVSA

257F1E11-VL (SEQ ID NO: 510)

DIVMTQSPSSLTEKAGERVSMSCKSSQSLFNSGNQKNYLTWYQQKPGQPPKLLIYWASTRESGVPDRF
TGSGSGTDFTLTISSVQAEDLAIYYCQNDYWYPFTFGAGTKLELK

257G7F7-VH (SEQ ID NO: 511)

QAYLQQSGAELVRSGASVKMSCKASGYTFTSHNLHWVKQTPGQGLEWIGYIYPGNGNTNYNQKFK
GKATLTADTSSSTAYMQISSLTSEDSAVYFCTRDYYGNSFAYWGQGTLVTVSA

257G7F7-VL (SEQ ID NO: 512)

DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNNYWFPFTFGAGTKLELK

260F8A6-VH (SEQ ID NO: 513)

QAYLQQSGAELVRSGASVKMSCRASGYTFTSHNMHWVKQTPGQGLEWIGYIYPGNGNTYYNQKFK
GKATLTADTSSNTAYMQINSLTSEDSAVYFCVRDYYGNSFVYWGQGTLVTVSA

260F8A6-VL (SEQ ID NO: 514)

DVVMTQSPSSLTEKTGEKVSMSCKSSQSLLNSGNQKNYLTWYQQKPGQPPKLLIYWASTRESGVPDR
FIGSGSGTDFTLTISSLQTEDLAVYYCQNNYMYPFTFGAGTKLELK

268D7H9-VH (SEQ ID NO: 515)

QAYLQQSGAELVRSGASVKMSCKASGYTFTNYNIHWVKQTPGQGLEWIGYIYPGNGGNYYNQKFK
GKATLTADTSSSTAYMQISSLTSEDSAVYFCARDYYGNSFAYWGQGTLVTVSA

268D7H9-VL (SEQ ID NO: 516)

DIAMTQSPSSLTVTAGEKVTMNCKSSQSLLNSGNQKNYLTWYQQKPGQPPKLLIYWASTRESGVPDR
FTGSGSGTDFTLTISSVQAEDLAIYYCQNDYYYPLTFGAGTTLELK

271B1B6-VH (SEQ ID NO: 517)

QAYLQQSGAELVRSGASVKMSCKASGYTFTNYNIHWVKQTPGQGLEWIGYIYPGNGGNYYNQKFK
GKATLTADTSSITAYMQISSLTSEDSAVYFCARDYYGNSFAYWGQGTLVTVSA

271B1B6-VL (SEQ ID NO: 518)

DIVMTQSPSSLTVTAGEKVTMNCKSSQSLLNSGNQKNYLTWYQQKPGQPPKLLIYWASTRESGVPDR
FTGSGSGTDFTLTISSVQAEDLAIYYCQNDYYYPLTFGAGTKLELK

275H9A2-VH (SEQ ID NO: 519)

QAYLQQSGAELVRSGASVKMSCRASGYSFTSHNMHWVKQTPGQGLEWIGYIYPGNGGSYYNQKFK
GKAILTADTSSSTAYMQISSLTSEDSAVYFCTRDYYGNSFVYWGQGTLVTVSA

275H9A2-VL (SEQ ID NO: 520)

DVVMTQSPSSLTEKTGEKVSMSCKSSQSLLNSGNQKNYLTWYQQKPGQPPKLLIYWASTRESGVPDR
FTGSGSGTDFTLTISSLQTEDLAVYYCQNNFRYPFTFGAGTKLELK

GROUP 2
185F2G12-VH (SEQ ID NO: 23)

QAYLQQSGAELVRSGASVKMSCKASGYTFTSYNMHWVRQTPGQGLEWIGYIYPGNGGTNYSQKFK
GKASLTADTSSTTAYMQISSLTSEDSAVYFCATGRGFAYWGQGTLVTVSA

185F2G12-VL (SEQ ID NO: 24)

DIVMTQSPSSLTVTAGEKVTLSCKSSQSLFNTGNQKNYLTWYQQKPGQPPKLLIFRASTRESGVPDRF
TGSGFGTDFTLTISSVQAEDLAVYYCQNDFSYPLTFGAGTKLELK

194D3B2-VH (SEQ ID NO: 25)

QAYLQQSGAELVRSGASVKMSCKASGYPFTSYNMHWVKQTPGQGLEWVGYIYPGNGGTNYNQKFR
DKATLTADTSSSTAYMQISRLTSDDSAVYFCLTGRGFAYWGQGTLVTVSA

194D3B2-VL (SEQ ID NO: 26)

DIVMTQSPSSLIVTPGERVTMSCKSSQSLLNSGNQKNYLTWYQQKPGQPPKLLIYRASTRESGVPDRFT
GSGSGTDFTLTISSVQAEDLAVYYCQNDYSYPLTFGIGTKLELK

207F8G5-VH (SEQ ID NO: 27)

QAYLQQSGAELVRSGASVKMSCKASGFTFTSYNIHWVKQTPGQGLEWIGYISPGNGGSNYNLKFKDK
ATLTSATSSSTAYMQISSLTSEDSAVYFCATGRGFAYWGQGTLVTVSA

207F8G5-VL (SEQ ID NO: 28)

DIVMTQSPSSLTVTPGEKVTMSCKSSQSLFNSGNQKNYLIWYQQKPGQPPKLLIYRASTRDSGVPDRF
TGSGSGTDFTLTISNVQAEDLAIYYCQNDYSYPLTFGAGTKLELK

Humanized 207F8G5-VH1

(SEQ ID NO: 337)

QVQLVQSGAEVKKPGASVKVSCKASGFTFTSYNIHWVRQAPGQGLEWMGYISPGNGGSNYNLKFKD
RVTMTRDTSISTAYMELSRLRSDDTAVYYCARGRGFAYWGQGTLVTVSS

Humanized 207F8G5-VH1.1

(SEQ ID NO: 338)

QVQLVQSGAEVKKPGASVKVSCKASGFTFTSYNIHWVKQAPGQGLEWMGYISPGNGGSNYNLKFKD
RVTMTSDTSISTAYMELSRLRSDDTAVYFCATGRGFAYWGQGTLVTVSS

Humanized 207F8G5-VH1.2

(SEQ ID NO: 339)

QVQLVQSGAEVKKPGASVKVSCKASGFTFTSYNIHWVKQAPGQGLEWIGYISPGNGGSNYNLKFKD
RATMTRDTSISTAYMELSRLRSDDTAVYFCATGRGFAYWGQGTLVTVSS

Humanized 207F8G5-VH1.3

(SEQ ID NO: 340)

QVQLVQSGAEVKKPGASVKVSCKASGFTFTSYNIHWVRQAPGQGLEWIGYISPGNGGSNYNLKFKDR
ATMTSDTSISTAYMELSRLRSDDTAVYFCATGRGFAYWGQGTLVTVSS

Humanized 207F8G5-VH1.4

(SEQ ID NO: 341)

QVQLVQSGAEVKKPGASVKVSCKASGFTFTSYNIHWVKQAPGQGLEWIGYISPGNGGSNYNLKFKD
RATMTSDTSISTAYMELSRLRSDDTAVYFCATGRGFAYWGQGTLVTVSS

Humanized 207F8G5-VH1.5

(SEQ ID NO: 342)

QVQLVQSGAEVKKPGASVKVSCKASGFTFTSYNIHWVKQAPGQGLEWMGYISPGNGGSNYNLKFKD
RVTLTSDTSISTAYMELSRLRSDDTAVYFCATGRGFAYWGQGTLVTVSS

Humanized 207F8G5-VH1.6

(SEQ ID NO: 343)

QVQLVQSGAEVKKPGASVKVSCKASGFTFTSYNIHWVKQAPGQGLEWIGYISPGNGGSNYNLKFKD
RATMTSDTSSSTAYMELSRLRSDDTAVYFCATGRGFAYWGQGTLVTVSS

Humanized 207F8G5-VH1.7

(SEQ ID NO: 344)

QVQLVQSGAEVKKPGASVKVSCKASGFTFTSYNIHWVKQAPGQGLEWMGYISPGNGGSNYNLKFKD
RVTLTSDTSISTAYMELSRLRSDDTAVYYCATGRGFAYWGQGTLVTVSS

Humanized 207F8G5-VH1.8

(SEQ ID NO: 345)

QVQLVQSGAEVKKPGASVKMSCKASGFTFTSYNIHWVKQAPGQGLEWIGYISPGNGGSNYNLKFKD
RATLTSDTSSSTAYMELSRLRSDDTAVYFCATGRGFAYWGQGTLVTVSS

Humanized 207F8G5-VL1

(SEQ ID NO: 346)

DIVMTQSPDSLAVSLGERATINCKSSQSLFNSGNQKNYLIWYQQKPGQPPKLLIYRASTRDSGVPDRFS
GSGSGTDFTLTISSLQAEDVAVYYCQNDYSYPLTFGGGTKLEIK

Humanized 207F8G5-VL1.1

(SEQ ID NO: 347)

DIVMTQSPDSLAVSPGERATMSCKSSQSLFNSGNQKNYLIWYQQKPGQPPKLLIYRASTRDSGVPDRF
SGSGSGTDFTLTISSLQAEDVAVYYCQNDYSYPLTFGGGTKLEIK

```
222B6G5-VH
                                                         (SEQ ID NO: 29)
QTYLQQSGAELVRSGASVKMSCKASGYTFTSYNIHWVKQTPGQGLEWIGYISPGNGGTYYNLKFKD
KATLTTATSSSTAYMQISSLTSEDSAVYFCATGRGFAYWGQGTLVTVSA

222B6G5-VL
                                                         (SEQ ID NO: 30)
DIVMTQSPSSLTVTPGEKVTMSCKSSQSLFNSGNQKNYLIWYQQKPGQPPKLLIYRASTRDSGVPDRF
TGSGSGTDFTLTISNVQAEDLAVYYCQNDYSYPLTFGAGTKLELK

182D10F1-VH
                                                         (SEQ ID NO: 31)
QAYLQQSGAELVRSGASVKMSCKASGYTFSSYNMHWVKQTPGQGLEWIGYIYPGNGGTNYNQKFK
GKATLTADTSSSTAYMQISSLTSEDSAVYFCLTGRGFTYWGQGTLVTVSA

182D10F1-VL
                                                         (SEQ ID NO: 32)
DIVMTQSPSSLTVTAGEKVTMNCKSSQSLFNSGNQKNYLTWYQQKPGQPPKLLIYRASTRESGVPDRF
TGSGSGTDFTLTISSVQAEDLAVYYCQNDYSYPLTFGVGTKLELK

234B9D4-VH
                                                         (SEQ ID NO: 33)
EIQLQQSGPDLMKPGSSVKISCTASGYSFTSYYIHWVKQSHGKTLEWIGYIDPFNGGTRYNQKFEGKA
ALTVDKSSTTAYMHLTSLTSDDSAVYYCASLRFFTYWGQGTLVTVSA

234B9D4-VL
                                                         (SEQ ID NO: 34)
DIVMTQSPSSLTVTAGEKVTMTCKSSQSLLNSGNQENYLTWYQQKPGQPPKLLISRASTROSGVPDRF
TGSGSGTDFTLTISSVQAEDLAVYYCQNDYSYPLTFGAGTKLELK

253E4F7-VH
                                                         (SEQ ID NO: 35)
EIQLQQSGPELMKPGASVKMSCKASGYSFTSYYIHWVKQSHGKSLEWIGYIDPFNGGTRYNQKFEGK
ATLTVDKSSTTAYMHLSSLTSEDSTVYYCASLRFLAYWGQGTLVTVSA

253E4F7-VL
                                                         (SEQ ID NO: 36)
DIVMTQSPSSLTVTAGEKVTMTCKSSQSLLNSGNQKNYLTWYQQKPGQPPKVLISRASTRQSGVPDRF
TGSGSGTDFTLTISSVQAEDLAVYYCQNDYSYPLTFGAGTKLELK

198F10B8-VH
                                                         (SEQ ID NO: 263)
QAYLQQSGAELVRSGASVRMSCKASGYTFSSYNMHWVKQTPGQGLEWIGYIYPGNGGTNYNQKFK
DKATLTADTSSSTAFIQISSLTSEDSAVYFCLTGRGFAYWGQGTLVTVSA

198F10B8-VL
                                                         (SEQ ID NO: 264)
DIVMTQSPSSLTVTAGERVTMSCKSSQSLFNSGNQKNYLTWYQQKPGQPPKLLIYRASTRESGVPDRF
TGSGSGTDFTLTISSVQAEDLAVYYCQNDYSYPLTFGVGTKLELK

213B10A4-VH
                                                         (SEQ ID NO: 265)
QAYVQQSGAELVRSGASVKMSCRASGYTFTSYNMHWVKQTPGQGLEWIGYIYPGNGGTYYNQKFK
GKATLTADTSSSTAYMQISSLTSEDSAVYFCATGRGFAYWGQGTLVTVSA

213B10A4-VL
                                                         (SEQ ID NO: 266)
DIVMTQSPSSLTVTAGEKVTMSCKSSQSLLNSGNQKNYLTWYQQKPGQPPKLLIYRASTRESGVPDRF
TGSGFGTDFTLTISSVQAEDLAVYYCQNDYSYPLTFGAGTKLELK

GROUP 3
370E2B12C3-VH
                                                         (SEQ ID NO: 37)
QVQLKESGPGLVAPSQSLSITCTVSGFSLTTYGVHWVRQPPGKGLEWLGVIWAGGSTNYNSALMSRV
SINKDNSKSQVFIKMNSLQADDTALYYCARAAYYGNGLDYWGQGTTLTVSS

370E2B12C3-VL
                                                         (SEQ ID NO: 38)
DIVMTQSPSSLTVTAGEKVTMSCKSSQTLLNSGNQKNYLTWYQQKPGQPPKLLIYWASTGESGVPDR
FTGSGSGTDFTLTISSVQAEDLAVYFCQNAYFYPFTFGGGTKLEIK

Humanized 370E2B12C3-VH1
                                                         (SEQ ID NO: 372)
QVQLQESGPGLVKPSETLSLTCTVSGFSLTTYGVHWIRQPPGKGLEWIGVIWAGGSTNYNSALMSRVT
ISVDTSKNQFSLKLSSVTAADTAVYYCARAAYYGNGLDYWGQGTMVTVSS
```

-continued

Humanized 370E2B12C3-VH2
(SEQ ID NO: 373)
EVQLVESGGGLIQPGGSLRLSCAASGFSLTTYGVHWVRQAPGKGLEWVSVIWAGGSTNYNSALMSR
FTISRDNSKNTLYLQMNSLRAEDTAVYYCARAAYYGNGLDYWGQGTLVTVSS Humanized 370E2B12C3-VH3
(SEQ ID NO: 374)
QVQLVESGGGVVQPGRSLRLSCAASGFSLTTYGVHWVRQAPGKGLEWVAVIWAGGSTNYNSALMS
RFTISRDNSKNTLYLQMNSLRAEDTAVYYCARAAYYGNGLDYWGQGTMVTVSS Humanized 370E2B12C3-VL1
(SEQ ID NO: 375)
DIVMTQSPDSLAVSLGERATINCKSSQTLLNSGNQKNYLTWYQQKPGQPPKLLIYWASTGESGVPDRF
SGSGSGTDFTLTISSLQAEDVAVYYCQNAYFYPFTFGGGTKLEIK Humanized 370E2B12C3-VL2
(SEQ ID NO: 376)
DIVMTQSPLSLPVTPGEPASISCKSSQTLLNSGNQKNYLTWYLQKPGQSPQLLIYWASTGESGVPDRFS
GSGSGTDFTLKISRVEAEDVGVYYCQNAYFYPFTFGGGTKVEIK Humanized 370E2B12C3-VL3
(SEQ ID NO: 377)
DVVMTQSPLSLPVTLGQPASISCKSSQTLLNSGNQKNYLTWFQQRPGQSPRRLIYWASTGESGVPDRF
SGSGSGTDFTLKISRVEAEDVGVYYCQNAYFYPFTFGGGTKVEIK 237D2A4-VH
(SEQ ID NO: 39)
QVQLKESGPGLVAPSQSLSITCTVSGFSLTSYGVSWVRQPPGKGLEWLGVIWGDGSTNYHSTLISRLRI
SKDKSKSQVFLKLNSLQTDDTATYYCAKAGRGNALDYWGQGTSVTVSS 237D2A4-VL
(SEQ ID NO: 40)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCONDYSFPLTFGAGTKLELK Humanized 237D2A4-VH1
(SEQ ID NO: 355)
QVQLQESGPGLVKPSETLSLTCTVSGFSLTSYGVSWIRQPPGKGLEWIGVIWGDGSTNYHSTLISRVTIS
VDTSKNQFSLKLSSVTAADTAVYYCARAGRGNALDYWGQGTLVTVSS Humanized 237D2A4-VH1.1
(SEQ ID NO: 356)
QVQLQESGPGLVKPSETLSLTCTVSGFSLTSYGVSWIRQPPGKGLEWIGVIWGDGSTNYHSTLISRVTIS
KDTSKSQFSLKLSSVTAADTAVYYCAKAGRGNALDYWGQGTLVTVSS Humanized 237D2A4-VH1.2
(SEQ ID NO: 357)
QVQLQESGPGLVKPSETLSLTCTVSGFSLTSYGVSWIRQPPGKGLEWIGVIWGDGSTNYHSTLISRVTIS
KDTSKNQVFLKLSSVTAADTAVYYCAKAGRGNALDYWGQGTLVTVSS Humanized 237D2A4-VH1.3
(SEQ ID NO: 358)
QVQLQESGPGLVKPSETLSLTCTVSGFSLTSYGVSWIRQPPGKGLEWIGVIWGDGSTNYHSTLISRVTIS
KDTSKSQVFLKLSSVTAADTAVYYCAKAGRGNALDYWGQGTLVTVSS Humanized 237D2A4-VH1.4
(SEQ ID NO: 359)
QVQLQESGPGLVKPSETLSLTCTVSGFSLTSYGVSWVRQPPGKGLEWIGVIWGDGSTNYHSTLISRVTI
SKDTSKSQFSLKLSSVTAADTAVYYCAKAGRGNALDYWGQGTLVTVSS Humanized 237D2A4-VH1.5
(SEQ ID NO: 360)
QVQLQESGPGLVKPSETLSLTCTVSGFSLTSYGVSWVRQPPGKGLEWLGVIWGDGSTNYHSTLISRLTI
SKDTSKNQFSLKLSSVTAADTAVYYCAKAGRGNALDYWGQGTLVTVSS Humanized 237D2A4-VH1.6
(SEQ ID NO: 361)
QVQLQESGPGLVKPSETLSLTCTVSGFSLTSYGVSWVRQPPGKGLEWLGVIWGDGSTNYHSTLISRLTI
SKDTSKSQFSLKLSSVTAADTAVYYCAKAGRGNALDYWGQGTLVTVSS Humanized 237D2A4-VH1.7
(SEQ ID NO: 362)
QVQLQESGPGLVKPSETLSLTCTVSGFSLTSYGVSWVRQPPGKGLEWLGVIWGDGSTNYHSTLISRLTI
SKDTSKSQVFLKLSSVTAADTAVYYCAKAGRGNALDYWGQGTLVTVSS Humanized 237D2A4-VL1
(SEQ ID NO: 363)
DIVMTQSPDSLAVSLGERATINCKSSQSLLNSGNQKNYLTWYQQKPGQPPKLLIYWASTRESGVPDRF
SGSGSGTDFTLTISSLQAEDVAVYYCQNDYSFPLTFGGGTKLEIK Humanized 237D2A4-VL1.1

(SEQ ID NO: 364)

DIVMTQSPDSLAVSLGERATMSCKSSQSLLNSGNQKNYLTWYQQKPGQPPKLLIYWASTRESGVPDR
FSGSGSGTDFTLTISSLQAEDVAVYYCQNDYSFPLTFGGGTKLEIK

203A6C9-VH (SEQ ID NO: 41)

QVQLKQSGPGLVQPSQSLSITCTVSGFSLTRYGVHWVRQSPGKGLEWLGVIWSGGNTDYNAAFISRL
NIRKDNSKSQVFFKMNSLKPNDTAIYYCARAAYFGNSFDYWGQGTTLTVSS

203A6C9-VL (SEQ ID NO: 42)

DIVMTQSPSSLPVTAGEKVTMSCKSSQSLLNSGNQKNYLTWYQQKPGQPPKLLIYWASTRDSGVPDR
FTGSGSGTDFTLTISSVQAEDLAVYYCQNNYIYPLTFGAGTKLELK

201F4H6-VH (SEQ ID NO: 43)

QVQLKESGPGLVAPSQSLSITCTVSGFSLTSYGVSWVRQPPGKGLECLGVIWAGGNTNYNSALMSRLS
ISKDKSKSQVFLKMNSLQTDDTAMYYCARVYYGNAMDYWGQGTSVTVSS

201F4H6-VL (SEQ ID NO: 44)

DIVMTQSPSSLTVTAGEKVTMSCKSSQSLLNSGNQKSYLTWYQQRPGQPPKLLIYWASTRESGVPDRF
TGSGSGTDFTLTISSVQAEDLAVYFCQNVYFFPFTFGSGTKLETK

200A4H8-VH (SEQ ID NO: 521)

QVQLKQSGPGLVQPSQSLSITCTVSGFSLTRYGVHWVRQSPGKGLEWLGVIWSGGNTDYNAAFISRL
NIRKDNSKSQVFFKMNSLKPNDTAIYYCARAAYFGNSFDYWGQGTTLTVSS

200A4H8-VL (SEQ ID NO: 522)

DIVMTQSPSSLPVTAGEKVTMSCKSSQSLLNSGNQKNYLTWYQQKPGQPPKLLIYWASTRDSGVPDR
FTGSGSGTDFTLTISSVQAEDLAVYYCQNNYIYPLTFGAGTKLELK

203 A6D5-VH (SEQ ID NO: 523)

QVQLKQSGPGLVQPSQSLSITCTVSGFSLTRYGVHWVRQSPGKGLEWLGVIWSGGNTDYNAAFISRL
NIRKDNSKSQVFFKMNSLKPNDTAIYYCARAAYFGNSFDYWGQGTTLTVSS

203 A6D5-VL (SEQ ID NO: 524)

DIVMTQSPSSLPVTAGEKVTMSCKSSQSLLNSGNQKNYLTWYQQKPGQPPKLLIYWASTRDSGVPDR
FTGSGSGTDFTLTISSVQAEDLAVYYCQNNYIYPLTFGAGTKLELK

248G8E8-VH (SEQ ID NO: 525)

QVQLKESGPGLVAPSQSLSITCTVSGFSLTTYGVSWVRQPPGKGLEWLGVIWGDGSTNYHSTLISRLRI
SKDKSKSQVFLKLNSLQTDDTATYYCAKAGRGNALDYWGQGTSVTVSS

248G8E8-VL (SEQ ID NO: 526)

DIVLTQSPSSLTVTAGEKVTMSCKSSQSLLNSGNQKNYLTWYQQKPGQPPKLLIYWASTRESGVPDRF
TGSGSGTDFTLTISSVQAEDLAVYYCQNDYSFPLTFGAGTKLELK

GROUP 4
429H6C5-VH (SEQ ID NO: 47)

DVQLVESGGGLVQPGGSRKLSCAASGFTFSSFGMHWVRQAPEKELEWVAYISSGSSTIYYAHTVKGR
FTISRDNPKNTLFLRMTSLGSEDTAMYYCVRFYYGNSFVNWGQGTLVTVSA

429H6C5-VL (SEQ ID NO: 48)

DIVMTQSPSSLTATAGEKVTMSCKSSQSLLNSGNQKNYLTWYQQKPGQPPKMLIYWASTRESGVPDR
FAGSGSGTDFTLTISSVQAEDLAVYYCQNAYIYPLTFGAGTRLELK

407D8G1-VH (SEQ ID NO: 49)

DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

407D8G1-VL (SEQ ID NO: 50)

DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

```
419B5G9-VH
                                                       (SEQ ID NO: 51)
DVQLVESGGGLVQPGGSRKLSCAASGFTFSTFGMHWVRQAPEKGLEWVAYISGGSTTIFYADTVKGR
FTISRDNPKNTLFLQMTSVRSEDTAMYYCARFYYGNSFAYWGPGTLVTVST

419B5G9-VL
                                                       (SEQ ID NO: 52)
DIVMTQSPSSLTVTAGEKVTMSCKSSQSLLNSGNQKNYLTWYQQKPGQPPKMLIYWASTRESGVPDR
FTGSGSGTDFTLTISSVQAEDLAVYYCQNAYSYPLTFGAGTKLELK

393C2C5-VH
                                                       (SEQ ID NO: 53)
DVQLVESGGGLVQPGGSRKLSCAASGTFSSFGMHWVRQAPEKGLEWVAYISSGSSPIYYADTVKGR
FTISRDNPKNTLFLQMTSLRSEDTAMYFCATFYYGNSFAYWGQGTLVTVSA

393C2C5-VL
                                                       (SEQ ID NO: 54)
DIVMTQSPSSLTVTAGEKVTMSCKSSQTLLNSGNQKNYLTWYQQKSGQPPKLLIYWASTRESGVPDR
FTGSGSGTDFTLTISSVQAEDLAVYYCQNAYSYPVTFGSGTKVELK

412B6E4-VH
                                                       (SEQ ID NO: 55)
DVQLVESGGGLVQPGGSRKLSCAASGFTFSSFGVHWVRQAPEKGLEWVAYISSGSSTIYYAHSVKGR
FTISRDNPKNTLFLQMTSLGSEDTATYYCARFYYGNSFAYWGQGTLVTVSA

412B6E4-VL
                                                       (SEQ ID NO: 56)
DIVMTQSPSSLTVTAGEKVTMSCKSSQSLLNSGNQKNYLTWYQQKPGQPPKMLIYWASTRESGVPDR
FTGSGSGTDFTLTISSVQAEDLAVYYCQNAYTYPLTFGAGTRLELK

Humanized 412B6E4-VH1
                                                       (SEQ ID NO: 383)
EVQLVESGGGLVQPGGSLRLSCAASGFTFSSFGVHWVRQAPGKGLEWVSYISSGSSTIYYAHSVKGRF
TISRDNAKNSLYLQMNSLRAEDTAVYYCARFYYGNSFAYWGQGTLVTVSS Humanized 412B6E4-VH1.1
                                                       (SEQ ID NO: 384)
EVQLVESGGGLVQPGGSLRLSCAASGFTFSSFGVHWVRQAPGKGLEWVAYISSGSSTIYYAHSVKGR
FTISRDNAKNSLFLQMNSLRAEDTAVYYCARFYYGNSFAYWGQGTLVTVSS Humanized 412B6E4-VH1.2
                                                       (SEQ ID NO: 385)
EVQLVESGGGLVQPGGSRRLSCAASGFTFSSFGVHWVRQAPGKGLEWVSYISSGSSTIYYAHSVKGRF
TISRDNAKNTLFLQMNSLRAEDTAVYYCARFYYGNSFAYWGQGTLVTVSS Humanized 412B6E4-VL1
                                                       (SEQ ID NO: 386)
DIVMTQSPDSLAVSLGERATINCKSSQSLLNSGNQKNYLTWYQQKPGQPPKLLIYWASTRESGVPDRF
SGSGSGTDFTLTISSLQAEDVAVYYCQNAYTYPLTFGQGTKLEIK Humanized 412B6E4-VL1.1
                                                       (SEQ ID NO: 387)
DIVMTQSPDSLAVSLGERATMSCKSSQSLLNSGNQKNYLTWYQQKPGQPPKMLIYWASTRESGVPDR
FSGSGSGTDFTLTISSLQAEDVAVYYCQNAYTYPLTFGQGTKLEIK 414A5F7-VH
                                                       (SEQ ID NO: 57)
DVQLVESGGGLVQPGGSRKLSCAASGFTFSSFGMHWVRQAPEKGLEWVAYISSGSSPIYYADTVKGR
FTISRDNPKNTLFLQMTSLRSEDTAMYFCARIYYGNSFAYWGQGTLVTVSA 414A5F7-VL
                                                       (SEQ ID NO: 58)
DIVMTQSPSSLTVTAGEKVAMSCKSSQTLLNSGNQKNYLTWYQQKPGQPPKLLLYWASTRESGVPD
RFTGSGSGTDFTLTISSVQAEDLAVYYCQNAYYYPLTFGSGTKLELK 418D2F9-VH
                                                       (SEQ ID NO: 59)
DVQLVESGGGLVQPGGSRKLSCAASGFTFSSFGMHWVRQAPEKGLEWVAYINTGSSTIYYADTVKG
RFTISRDNPKNTLFLQMTSLRSEDTAMYYCARIYYGNSFVYWGQGTLVTVSA 418D2F9-VL
                                                       (SEQ ID NO: 60)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCQNDYSYPLTFGAGTKLELK 410H6H3-VH
                                                       (SEQ ID NO: 61)
DVLLVESGGGLVQPGGSRKLSCAASGFTFSSSGMHWVRQAPEKGLEWVAYISSGSNTIYYADTLKGR
FTISRDNPKNTLFLQMTSLRSEDTAMYYCARIYYGNSFVYWGQGTLVTVSA
```

-continued

410H6H3-VL (SEQ ID NO: 62)
DIVMTQSPSSLTVTAGEKVIMSCKSSQSLLNSGNQKNYLTWYQQKPGQPPKMLIYWASTRESGVPDR
FRGSGSGTDFTLTISSVQAEDLAVYYCQNNYYYPLTFGTGTKLALK

Humanized 410H6H3-VH1

(SEQ ID NO: 378)
EVQLVESGGGLVQPGGSLRLSCAASGFTFSSSGMHWVRQAPGKGLEWVSYISSGSNTIYYADTLKGR
FTISRDNAKNSLYLQMNSLRAEDTAVYYCARIYYGNSFVYWGQGTLVTVSS

Humanized 410H6H3-VH1.1

(SEQ ID NO: 379)
EVQLVESGGGLVQPGGSLRLSCAASGFTFSSSGMHWVRQAPGKGLEWVAYISSGSNTIYYADTLKGR
FTISRDNAKNSLFLQMNSLRAEDTAVYYCARIYYGNSFVYWGQGTLVTVSS

Humanized 410H6H3-VH1.2

(SEQ ID NO: 380)
EVQLVESGGGLVQPGGSRRLSCAASGFTFSSSGMHWVRQAPGKGLEWVSYISSGSNTIYYADTLKGR
FTISRDNAKNTLFLQMNSLRAEDTAVYYCARIYYGNSFVYWGQGTLVTVSS

Humanized 410H6H3-VL1

(SEQ ID NO: 381)
DIVMTQSPDSLAVSLGERATINCKSSQSLLNSGNQKNYLTWYQQKPGQPPKLLIYWASTRESGVPDRF
SGSGSGTDFTLTISSLQAEDVAVYYCQNNYYYPLTFGQGTKLEIK

Humanized 410H6H3-VL1.1

(SEQ ID NO: 382)
DIVMTQSPDSLAVSLGERATMSCKSSQSLLNSGNQKNYLTWYQQKPGQPPKMLIYWASTRESGVPDR
FSGSGSGTDFTLTISSLQAEDVAVYYCQNNYYYPLTFGQGTKLEIK

391F1G2-VH (SEQ ID NO: 527)
DVQLVESGGGLVQPGGSRKLSCAASGFTFSSFGMHWVRQAPEKGLEWVAYISSGSSPIYYADTVKGR
FTISRDNPKNTLFLQMTSLRSEDTAMYFCARIYYGNSFAYWGQGTLVTVSA

391F1G2-VL (SEQ ID NO: 528)
DIVMTQSPSSLTVTAGEKVAMSCKSSQTLLNSGNQKNYLTWYQQKPGQPPKLLLYWASTRESGVPD
RFTGSGSGTDFTLTISSVQAEDLAVYYCQNAYYYPLTFGSGTKLELK

406F11G8-VH (SEQ ID NO: 529)
DVQLVESGGGLVQPGGSRKLSCAASGFTFSSFGMHWVRQAPEKGLEWVAYISSGSSPIYYADTVKGR
FTISRDNSKNTLFLQMTSLRSEDTAMYFCARIYYGNSFAYWGQGTLVTVSA

406F11G8-VL (SEQ ID NO: 530)
DIVMTQSPSSLTVTAGEKVAMSCKSSQTLLNSGNQKNYLTWYQQKPGQPPKLLIYWASTRESGVPDR
FTGSGSGTDFTLTISSVQAEDLAVYYCQNAYYYPLTFGSGTKLELK

410A9A9-VH (SEQ ID NO: 531)
DVQLVESGGGLVQPGGSRKLSCAASGFTFSSFGMHWVRQAPEKGLEWVAYISSGSSPIYYADTVKGR
FTISRDNPKNTLFLQMTSLRSEDTAMYFCATFYYGNSFAYWGQGTLVTVSA

410A9A9-VL (SEQ ID NO: 532)
DIVMTQSPSSLTVTAGEKVTMSCKSSQTLLNSGNQKNYLTWYQQKSGQPPKLLIYWASTRESGVPDR
FTGSGSGTDFTLTISSVQAEDLAVYYCQNAYSYPVTFGSGTKVELK

410D9G2-VH (SEQ ID NO: 533)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

410D9G2-VL (SEQ ID NO: 534)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

416F12F3-VH (SEQ ID NO: 535)
DVQLVESGGGLVQPGGSRKLSCAASGFTFSSFGMHWVRQAPEKGLEWVAYISSGSSTIYYAHSVKGR
FTISRDNPKNTLFLQMTSLGSEDTAMYYCARFYYGNSFAYWGQGTLVTVSA

416F12F3-VL (SEQ ID NO: 536)
DIVMTQSPSSLTVTAGEKVTLSCKSSQSLLNSGNQKNYLTWYQQKPGQPPKMLIYWASTRESGVPDR
FTGSGSGTDFTLTISSVQAEDLAVYYCQNAYTYPLTFGAGTRLELK

-continued

420H3H9-VH (SEQ ID NO: 537)
DVQLVESGGGLVQPGGSRKLSCAASGFTFSSFGMHWVRQAPEKGLEWVAYISSGSSTIYYAHSVKGR
FTISRDNPKNTLFLQMTSLGSEDTAMYYCARFYYGNSFAYWGQGTLVTVSA

420H3H9-VL (SEQ ID NO: 538)
DIVMTQSPSSLTVTAGEKVTLSCKSSQSLLNSGNQKNYLTWYQQKPGQPPKMLIYWASTRESGVPDR
FTGSGSGTDFTLTISSVQAEDLADYYCQNAYTYPLTFGAGTRLELK

411G12G1-VH (SEQ ID NO: 539)
DVQLVESGGGLVQPGGSRKLSCAASGFTFSGFGMHWIRQAPEKGLEWVAYISSGSRPIYYADTVKGR
FTISRDNPKNTLFLQMTSLRSEDTAMYFCARFYYGNSFDHWGQGTLVTVSA

411G12G1-VL (SEQ ID NO: 540)
DIVMTQSPSFLTVTAGEKVTMSCKSSQSLLNSGNQKNYLTWYQQKPGQPPKLLIYWASTRESGVPDR
FTGSGSGTDFTLTISSVQAEDLAVYYCQNDYSFPLTFGAGTKLELK

429G4E9-VH (SEQ ID NO: 541)
DVQLVESGGGLVQPGGSRKLSCAASGFTFSSFGMHWVRQAPEKGLEWVAYISSGSSPIYYADTVKGR
FTISRDNPKNTLFLQMTSLRSEDTAMYFCATFYYGNSFAYWGQGTLVTVSA

429G4E9-VL (SEQ ID NO: 542)
DIVMTQSPSSLTVTAGEKVTMSCKSSQTLLNSGNQKNYLTWYQQKSGQPPKLLIYWASTRESGVPDR
FTGSGSGTDFTLTISSVQAEDLAVYYCQNAYSYPVTFGSGTKVELK

391H11H3-VH (SEQ ID NO: 543)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

391H11H3-VL (SEQ ID NO: 544)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

395B3C11-VH (SEQ ID NO: 545)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

395B3C11-VL (SEQ ID NO: 546)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

406E1H7-VH (SEQ ID NO: 547)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

406E1H7-VL (SEQ ID NO: 548)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

414H6G2-VH (SEQ ID NO: 549)
DVQLVESGGGLVQPGGSRKLSCAASGFTFSGFGMHWIRQTAEKGLEWVAYISSGSRPIYYADTVQGR
FTISRDNPKNTLFLQMTSLRSEDTAMYFCARFYYGNSFDHWGQGTLVTVSA

414H6G2-VL (SEQ ID NO: 550)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

420G10G3-VH (SEQ ID NO: 551)
DVQLVESGGGLVQPGGSRKLSCAASGFTFSGFGMHWIRQTAEKGLEWVAYISSGSRPIYYADTVQGR
FTISRDNPKNTLFLQMTSLRSEDTAMYFCARFYYGNSFDHWGQGTLVTVSA

420G10G3-VL (SEQ ID NO: 552)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

```
422E8F9-VH
                                                      (SEQ ID NO: 553)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

422E8F9-VL
                                                      (SEQ ID NO: 554)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

422F4B6-VH
                                                      (SEQ ID NO: 555)
DVQLVESGGGLVQPGGSRKLSCAASGFSFSSFGMHWVRQAPEKGLEWVAYISSGSSPIYYADTVKGR
FIISRDNPKNTLFLQMTSLRSEDTAMYFCARIYYGNSFAYWGQGTLVTVSA

422F4B6-VL
                                                      (SEQ ID NO: 556)
DIVMTQSPSSLTVTAGEKVTMSCKSSQTLLNSGNQKNYLTWYQQKPGQPPKLLIYWASTRESGVPDR
FTGSGSGTDFTLTISSVQAEDLAVYYCQNAYSYPLTFGSGTKLELK

425B3D5-VH
                                                      (SEQ ID NO: 557)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

425B3D5-VL
                                                      (SEQ ID NO: 558)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

425C6D3-VH
                                                      (SEQ ID NO: 559)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

425C6D3-VL
                                                      (SEQ ID NO: 560)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

426H6E11-VH
                                                      (SEQ ID NO: 561)
DVQLVESGGGLVQPGGSRKLSCAASGFTFSGFGMHWIRQTPEKGLEWVAYISSGSRPIYYADTVQGR
FTISRDNPKNTLFLQMTSLRSEDTAMYFCARFYYGNSFDHWGQGTLVTVSS

426H6E11-VL
                                                      (SEQ ID NO: 562)
DIVMTQFPSFLTVTAGEKVTMSCKSSQTLLNSGNQKNYLTWYQQKPGQPPKLLIYWASTRESGVPDR
FTGSGSGTDFTLTISSVQAEDLALYYCQNAYSFPLTFGAGTNLELK

OTHERS
246B5F2-VH
                                                      (SEQ ID NO: 45)
EVMLVESGGGLMKPGGSLKLSCAASEFTFSNYAMSWVRQTPEKRLEWVATISSGRSSTYYPDSVKGR
FTISRDNAKNTLYLQMSSLRSEDTAMYYCAGLGRGNAMEYWGQGTSVTVSS

246B5F2-VL
                                                      (SEQ ID NO: 46)
DIVMTQSPSSLTVTAGEKVTLSCKSSQSLLNSGNQKNYLTWYQQKPGQPPKLLIYWASTRESGVPDRF
TGSGSGTDFILTINSVQAEDLAVYYCQNAYSYPFTFGSGTKLEIK

Humanized 246B5F2-VH1
                                                      (SEQ ID NO: 365)
EVQLLESGGGLVQPGGSLRLSCAASEFTFSNYAMSWVRQAPGKGLEWVSTISSGRSSTYYPDSVKGR
FTISRDNSKNTLYLQMNSLRAEDTAVYYCAKLGRGNAMEYWGQGTLVTVSS Humanized 246B5F2-VH1.1
                                                      (SEQ ID NO: 366)
EVQLLESGGGLVQPGGSLRLSCAASEFTFSNYAMSWVRQAPGKRLEWVATISSGRSSTYYPDSVKGR
FTISRDNSKNTLYLQMNSLRAEDTAVYYCAGLGRGNAMEYWGQGTLVTVSS Humanized 246B5F2-VH1.2
                                                      (SEQ ID NO: 367)
EVQLLESGGGLVQPGGSLRLSCAASEFTFSNYAMSWVRQAPGKGLEWVATISSGRSSTYYPDSVKGR
FTISRDNAKNTLYLQMNSLRAEDTAVYYCAGLGRGNAMEYWGQGTLVTVSS
```

-continued

Humanized 246B5F2-VH1.3

(SEQ ID NO: 368)
EVQLLESGGGLVQPGGSLRLSCAASEFTFSNYAMSWVRQAPGKRLEWVATISSGRSSTYYPDSVKGR
FTISRDNAKNTLYLQMNSLRAEDTAVYYCAGLGRGNAMEYWGQGTLVTVSS

Humanized 246B5F2-VH1.4

(SEQ ID NO: 369)
EVMLLESGGGLVQPGGSLRLSCAASEFTFSNYAMSWVRQAPGKRLEWVATISSGRSSTYYPDSVKGR
FTISRDNAKNTLYLQMNSLRAEDTAVYYCAGLGRGNAMEYWGQGTLVTVSS

Humanized 246B5F2-VL1

(SEQ ID NO: 370)
DIVMTQSPDSLAVSLGERATINCKSSQSLLNSGNQKNYLTWYQQKPGQPPKLLIYWASTRESGVPDRF
SGSGSGTDFTLTISSLQAEDVAVYYCQNAYSYPFTFGGGTKLEIK

Humanized 246B5F2-VL1.1

(SEQ ID NO: 371)
DIVMTQSPDSLAVSLGERATISCKSSQSLLNSGNQKNYLTWYQQKPGQPPKLLIYWASTRESGVPDRF
TGSGSGTDFTLTISSLQAEDVAVYYCQNAYSYPFTFGGGTKLEIK

418G6A5-VH (SEQ ID NO: 63)
DVQLVESGGGLVQPGGSRKLSCVASGFTFSSFGMHWVRQAPEKGLEWVAYISSGSSPMYYADTVKG
RFTISRDNPKNTLFLQMTSLRSEDTAMYFCARIYYGNSFAYWGQGTLVTVSA

418G6A5-VL (SEQ ID NO: 64)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCQNAYSYPLTFGAGTKLELK

417A6F11-VH (SEQ ID NO: 65)
EVQLQQSGPELVKPGASMKISCKASGYSFTGYTMNWVKQSHGKNLEWIGLINPYNGGTSYNQKFKG
KATLTVDKSSSTAYMELLSLTSEDSAVYYCARGDYWGQGTTLTVSS

417A6F11-VL (SEQ ID NO: 66)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCQNDYSYPTFGAGTKLELK

59B6C4-VH (SEQ ID NO: 67)
EVQLQQSGTVLARPGTSVKMSCKASGYRFTSSWMHWVKQRPGQGLEWIGANYPGKSDTTYTQKFK
GKARLTAVTSASTAYMELSSLTNEDSAVYYCARGAYYGNAMDYWGQGTSVTVSS

59B6C4-VL (SEQ ID NO: 68)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYSCQNAYSYPFTFGAGTKLELK

28C5B1-VH (SEQ ID NO: 251)
QVQLQQSGAELMKPGASVKISCKATGYTFSSYWIEWVKQRPGHGLEWIGEILPGSGSTNYNEKFKGK
ATFTADTSSNTAYMQLSSLTSEDSAVYYCARYGGLRRYFDYWGQGTTLTVSS

28C5B1-VL (SEQ ID NO: 252)
DIVMTQSHKFMSTSVGDRVSITCKASQDVSTAVAWYQQKPGQSPKLLIYSASYRYTGVPDRFTGSGS
GTDFTFTISSVQAEDLAVYYCQQHYSTPRTFGGGTKLEIK

35E8D2-VH (SEQ ID NO: 253)
QIQLVQSGPELKKPGETVRISCKASGYTFTTAGMQWVQKMPGKGLKWIGWINTHSRVPNFAEDFKGR
FAFSLETSARIAYLQISNIKNEDMATYFCARLGKGNTMDFWGQGTSVTVSS

35E8D2-VL (SEQ ID NO: 254)
DIVMTQSPSSLTVTVGEKVTMSCKSSQSLLNSGNQKNYLTWYQQKPGQPPKLLIYWASTRESGVPDR
FTGSGSETDFTLTISSLQAEDLAVYYCQNSYSFPLTFGGGTNLEIK

61H12G10-VH (SEQ ID NO: 255)
QVQLKESGPGLVAPSQSLSITCTVSGFSLTDYGVSWIRQPPGKGLEWLGVIWGGGSTYYNSALKSRLII
SKDNSKSQVFLKMNSLQTDDTAIYYCAKHHYGNACDYWGQGTTLTVSS

-continued

61H12G10-VL (SEQ ID NO: 256)
DIVMTQSPSSLTVTAGEKVTMSCKSSQSLFNSGNLKNYLTWYQQKPGQPPKLLICWASTRESGVPDRF
TGSGSGTEFTLTISSVQAEDLAVYYCQNDYSYPFTFGSGTKLEIK

69D5C1-VH (SEQ ID NO: 257)
EVKLVESGGGLVQPGGSRKLSCAASGFTFRDYGMAWVRQAPGKGPEWITFISNLAYSIYYADTVTGR
FTISTENAKNTLYLEMSSLRSEDTAMYYCAVIYYGNSFAYWGQGTLVTV

69D5C1-VL (SEQ ID NO: 258)
DIVLTQSPSSLTVTAGEKVTMSCKSSQSLLNSGNLRNYLTWYQQKPGQPPKLLIYWASTRESGVPDRF
TGSGSGTDFTLTISSLQAEDLAIYYCQNGYSYPFTFGSGTKLEIK

181C7B2-VH (SEQ ID NO: 259)
QVQLKQSGPGLVQPSQSLSITCTVSGFSLTYYGVHWVRQSPGKGLEWLGVIWRGGNTDYNAAFISRL
SINKDNSKSQVFFKMNSLQPNDTAIYYCARAAYYGNCFDYWGQGTTLTVSS

181C7B2-VL (SEQ ID NO: 260)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCQNNYIYPLTFGAGTKLELK

196A12B10-VH (SEQ ID NO: 261)
QIQWVQSGPELKKPRETVKISCKASGYTFTDYSMHWVKQAPGKGLKWMGWINSETGEATYADDFR
GRFALSLETSATTAFLQINSLKNEDTGTYFCARFYYGNSFASWGQGTTLTVSS

196A12B10-VL (SEQ ID NO: 262)
DIVMTQFPSSLTVTAGEKVTMTCKSSQSLLNGGNQKNYLTWYQQKPGLPPKLLIYWASTRESGVPDR
FTGSGSGTEFTLTISSVQAEDLAVYYCQNNYYFPLTFGAGTKLELK

232D7C8-VH (SEQ ID NO: 267)
QAYLQQSGAELVRSGASVKMSCKASGYTFTSHNMHWVKQTPGQGLEWIGYIYPGNGGTNYNQKFK
GKATLTADTSSSTAYMQISSLTSEDSAVYFCARDYFGNSFAYWGQGTLVTVSA

232D7C8-VL (SEQ ID NO: 268)
DILMTQSPSSLTATAGEKVSMSCKSSQSLFNSGNQRNYLTWYQQRPGQPPKLLIYWASTRESGVPDRF
TGSGSGTDFTLTISSVQAEDLAVYYCQNDYRYPFTFGAGTKLELK

233D5E5-VH (SEQ ID NO: 269)
QAYLQQSGAELVRSGASVKMSCKASGYTFTSHNMHWVKQTPRQGLEWIGYIYPGNGDTNYNQKFK
GKATLTADTSSSTAYMQISSLTSEDSAVYFCTRDYYGNSFAYWGQGTLVTVSA

233D5E5-VL (SEQ ID NO: 270)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNAYWYPFTFGAGTKLELK

232F1E4-VH (SEQ ID NO: 271)
QVQLKESGPGLVAPSQSLSITCTVSGFALTTYGVSWVRQPPGKGLEWLGVIWGDGSTHYHSALISRLS
IRKDNSKSQVFLKLNSLQTDDTATYYCAKPGRGNAMDYWGQGTSVTVSS

232F1E4-VL (SEQ ID NO: 272)
DIVMSQSPSSLTVTAGEKVTMSCKSSQSLLNSGNQKNYLTWYQQKPGQSPKLLIYWASTRESGVPDR
FTGSGSGTDFTLTISSMQAEDLAVYYCQNDYIYPLTFGAGTMLELK

231H4G11-VH (SEQ ID NO: 273)
QAYLQQSGAELVRSGASVKMSCKASGYTFTSHNIHWVKQTPGQGLEWIGYISPGNGYTNYNQKFRG
KATLTADTSSSTAYMQISSLTSEDSAVYFCTRDYYGNSFAYWGQGTLVTVSA

231H4G11-VL (SEQ ID NO: 274)
DIVMTQSPSSLTEKAGERVSMSCKSSQSLFNSGSQKNYLTWYQQKPGQPPKLLIYWASTRESGVPDRF
SGSGSGTDFTLTISSVQAEDLAVYYCQNNYWFPFTFGAGTKLELK

-continued

226A4B5-VH (SEQ ID NO: 275)
QAYLQQSGAELVRSGASVRMSCKASGFTFTSYNIHWVKQTPGQGLEWIGYIYPGSGGSNYNQKFMG
KATLTADTSSSTVYMQISSLTSEDSAVYFCATGRGFAYWGQGTLVTVSA

226A4B5-VL (SEQ ID NO: 276)
DIVMTQSPSSLTVTAGEKVTMSCKSSQSLFNSGNQKNYLTWYQQKPGQPPKLLIYRASTRESGVPDRF
TGSGSGTDFTLTISSVQAEDLAVYYCQNDYSYPLTFGTGTKLELK

235A10C9-VH (SEQ ID NO: 277)
QAYLQQSGAELVRSGASVKMSCKASGYTFASHNMHWVKQTPGQGLEWIGYIYPGNSGTKYNQKFT
GKATLTADTSSSTAYMQITSLTSEDSAVYFCARDYYGNSFAYWGQGTLVTVSA

235A10C9-VL (SEQ ID NO: 278)
DIVMTQSPSSLTEKAGEKVSMRCKSSQSLLNSGNQKNYLTWYQQKPGQPPKLLIYWASTRESGVPDR
FTGSGSGTDFTLTISSVQADDLAVYYCQNDYMFPFTFGAGTKLELK

239H12G9-VH (SEQ ID NO: 279)
QAYLQQSGAELVRSGASVKMSCKASGYTFTSHNIHWVKQTPGQGLEWIGYIYPGNGAPNYNQKFRG
KATLTADTSSSTAYMQISSLTSEDSAVYFCARDYYGNSFVYWGQGTLVTVSA

239H12G9-VL (SEQ ID NO: 280)
DIVMTQSPSSLTEKAGEKVSMSCKSSQSLLNSGNQKNYLTWYQQKPGQPPKLLIYWASTRESGVPDR
FTGSGSGTDFTLTISSVQAEDLAVYYCQNDYRYPFTFGAGTKLELK

248E6A7-VH (SEQ ID NO: 283)
QAYLQQSGAELVRSGASVKMSCRASGYTFTSHNMHWVKQTPGQGLEWIGYIYPGNGNTYYNQKFK
VKATLTADTSSNTAYMQINSLTSEDSAVYFCVRDYYGNSFVYWGQGTLVTVSA

248E6A7-VL (SEQ ID NO: 284)
DVVMTQSPSSLTEKTGEKVTMTCKSSQSLLNSGNQKNYLAWYQQKPGQPPKLLIYWASTRESGVPD
RFIGSGSGTDFTLTISSLQTEDLAVYYCQNNYMYPFTFGAGTKLELK

254A8D5-VH (SEQ ID NO: 285)
EVMLVESGGGLVKPGGSLKLSCAASGFTFSSYTVSWVRQTPEKRLEWVATSIVGSTYTYFPDSVKGR
FTISRDFAKNTLFLQMSSLRSEDTAMYYCSRLGRGNAMDYWGQGTSVSVSS

254A8D5-VL (SEQ ID NO: 286)
DIVMTQSPSSLTVTAGEKVTLNCRSSQSLLNSGNQKNYLTWYQQKPGQPPKLLIYWASTRESGVPDRF
TGSGSGTDFTLTISSVQADDLAVYYCQNGYSYPFTFGSGTKLEIK

259C6F4-VH (SEQ ID NO: 287)
QAYLQQSGAELVRSGASVKMSCKASGYTFSSHNIHWVKQTPGQGLEWIGYIYPGNGDTNYNQKFKG
KATLTADTSSSTAYMQISSLTSEDSAVYFCARDYYGNSFVYWGQGTLVTVSA

259C6F4-VL (SEQ ID NO: 288)
DIVMIQSPSSLTEKAGEKVSMSCKSSQSLLNSGNQKNYLTWYQQKPGQPPKLLIYWASTRESGVPDRF
TGSGSGTDFTLTISSVQAEDLAVYYCQNAYRFPFTFGAGTKLELK

280F3B6-VH (SEQ ID NO: 289)
QAYLQQSGAELVRSGASVKMSCKASGYTFTSHNMHWVKQTPGQGLEWIGYIYPGNGGTNYNQKFK
GKATLTADTSSSTAYMQISSLTSEDSAVYFCTRDYYGNSFAYWGQGTLVTVSA

280F3B6-VL (SEQ ID NO: 290)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNDYWYPFTFGAGTKLELK

59B6C9E8-VH (SEQ ID NO: 563)
EVQLQQSGTVLARPGTSVKMSCKASGYRFTSSWMHWVKQRPGQGLEWIGANYPGKSDTTYTQKFK
GKARLTAVTSASTAYMELSSLTNEDSAVYYCARGAYYGNAMDYWGQGTSVTVSS

-continued

59B6C9E8-VL (SEQ ID NO: 564)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYSCQNAYSYPFTFGAGTKLELK

186F7E10-VH (SEQ ID NO: 565)
EVMLVESGGGLVKPGGSLKLSCAASRFTLNSYAMSWIRQTPEKKLEWVATITSGVSHTYYFDSVKGR
FTISRDTAKNTLNLQMNSLRSEDTAVYYCARLYYGNSLDYWGQGTSVTVSS

186F7E10-VL (SEQ ID NO: 566)
DIVMTQSPSSLTVTAGEKVTVSCKSSQSLLNSGNQKNYLTWYQQKPGQPPKLLIYWASTRESGVPDRF
TGSGSGTDFTLTISSVQSEDLAVYYCQNNYIYPLTFGAGTTLELK

186G12H3-VH (SEQ ID NO: 567)
EVMLVESGGGLVKPGGSLKLSCAASRFTLSSYAMSWVRQTPEKRLEWVATISSGGSYTYYFDSVKGR
FTISRDTAKNTLNLQMSSLRSEDTAMYYCARLYYGNALDYWGQGTSVTVSS

186G12H3-VL (SEQ ID NO: 568)
DIVMTQSPSSLTVTAGEKVTVSCKSSQSLLNSGNQKNYLTWYQQKPGQPPKLLIYWASTRESGVPDRF
TGSGSGTDFTLTISSVQAEDLAVYYCQNNYIYPLTFGAGTTLELK

194A2F7-VH (SEQ ID NO: 569)
QIQLVQSGPELKKPGETVKISCKASGYTFTDYLIHWVKQAPGKGLKWMGWINTETGEPTYADDFKGR
FALSLETSASTACLQINNLKNEDTATYFCARIYYGNSFDYWGQGTTLTVSS

194A2F7-VL (SEQ ID NO: 570)
DIVMTQSPSSLPVTAGEKVTMTCKSSQNLLNSGNQKSYLTWYQQKPGQPPKLLIYWASTRETGVPDR
FTGSGSGTDFTLTISSVQAEDLAVYYCQNAYRFPFTFGAGTRLELK

217D9G2-VH (SEQ ID NO: 571)
QAYLQQSGAELVRSGASVKMSCKASGFTFTSYNIHWVKQTPGQGLEWIGYISPGNGGSNYNLNFKDK
ATLTAATSSTTAYMQISSLTSEDSAVYFCATGRGFAYWGQGTLVTVSA

217D9G2-VL (SEQ ID NO: 572)
DIVMTQSPSSLTVTPGEKVTMSCRSSQSLFNSGNQKNYLIWYQQKPGQPPKLLIYRASTRDSGVPDRF
TGSGSGTDFTLTISNVQAEDLAVYYCQNDYSYPLTFGAGTKLELK

219F9B8-VH (SEQ ID NO: 573)
QAYLQQSGAELVRSGASVRMSCKASGYTFTSYNMHWVKQTPGQGLEWIGYIYPGNGHTNYNQKFK
GKATLTADTSSSTAYMQISSLTSEDSAVYFCATGRGFAYWGQGTLVTVSA

219F9B8-VL (SEQ ID NO: 574)
DIVMTQSPSSLTVTAGEKVTMSCKSSQSLLNSGNQKNYLTWYQQKPGQPPKLLIYRASTRESGVPDRF
TGSGSGTDFTLTISSVQAEDLAVYYCQNDYSYPLTFGVGTKLELK

231C11E9-VH (SEQ ID NO: 575)
EVMLVESGGGLVKPGGSLKLSCAASGFTFNNYVMCWVRQTPEKRLEWVATISSGNFYTYYPDSVKG
RFTISRDNAKNTLYLQMSSLRSEDTAIYYCASLGRGNALDNWGQGTSVTVSS

231C11E9-VL (SEQ ID NO: 576)
DIVMTQSPASLTVTAKEKVTMSCRSSQSLLNSGNQKNYLTWYQQKPGQPPKLLIYWASTRESGVPDR
FTGSGSGTDFTLTISSVQAEDLAVYYCQNDYSYPFTFGSGTKLEIK

234C9G5-VH (SEQ ID NO: 577)
QAYLQQSGAELVRSGASVKMSCKASGYAFTSHNMHWVKQTPGQGLEWIGYISPGNGYTNYNQKFR
GKATLTADTSSSTAYMQIGSLTSEDSAVYFCTRDYYGNSFAYWGQGTLVTVSA

234C9G5-VL (SEQ ID NO: 578)
DIVMTQSPSSLTEKAGERVSMSCKSSQSLENSGNQKNYLTWYQQKPGQPPKLLIYWASTRESGVPDRF
TGSGSGTDFTLTISSVQAEDLAVYYCQNNYWFPFTFGAGTKLELK

```
234E1F12-VH
                                                              (SEQ ID NO: 579)
QAYLQQSGAELVRSGASVKMSCKASGYTFTSHNMHWVKQTPRQGLEWIGYIYPGNGDTNYNQKFK
GKATLTADTSSSTAYMQISSLTSEDSAVYFCTRDYYGNSFAYWGQGTLVTVSA

234E1F12-VL
                                                              (SEQ ID NO: 580)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNAYWYPFTFGAGTKLELK

240A8E7-VH
                                                              (SEQ ID NO: 581)
QAYLQQSGAELVRSGASVKMSCKASGYTFTNYNIHWVKQTPGQGLEWIGYIYPGNGDNYYNQKFK
GKATLTADTSSSTAYMQISSLTSEDSAVYFCARDYYGNSFAYWGQGTLVTVSA

240A8E7-VL
                                                              (SEQ ID NO: 582)
DVVMTQSPSSLTVTAGEKVTMNCKSSQSLLNSGNQKNYLTWYQQKPGQPPKMLIYWASTRESGVPD
RFTGSGSGTDFTLTISSVQAEDLAIYYCQNDYYYPFTFGAGTKLELK

242F5H2-VH
                                                              (SEQ ID NO: 583)
EVMLVESGGGLVKPGGSLKLSCAASGFTFSSYTVSWVRQTPEKRLEWVATSIVGSTYTYFPDSVKGR
FTISRDFAKNTLFLQMSSLRSEDTAMYYCSRLGRGNAMDYWGQGTSVSVSS

242F5H2-VL
                                                              (SEQ ID NO: 584)
DIVMTQSPSSLTVTAGEKVTLNCRSSQSLLNSGNQKNYLTWYQQKPGQPPKLLIYWASTRESGVPDRF
TGSGSGTDFTLTISSVQADDLAVYYCQNGYSYPFTFGSGTKLEIK

244A1B8-VH
                                                              (SEQ ID NO: 585)
QAYLQQSGAELVRSGASVKMSCKASGYTFTSHNIHWVKQTPGQGLEWIGYIYPGNGAPNYNQKFRG
KATLTADTSSSTAYMQISSLTSEDSAVYFCARDYYGNSFVYWGQGTLVTVSA

244A1B8-VL
                                                              (SEQ ID NO: 586)
DIVMTQSPSSLTEKAGEKVSMSCKSSQSLLNSGNQKNYLTWYQQKPGQPPKLLIYWASTRESGVPDR
FTGSGSGTDFTLTISSVQAEDLAVYYCQNDYRYPFTFGAGTKLELK

252C10F6-VH
                                                              (SEQ ID NO: 587)
QVHLKQSGRGLVQPSQSLSITCTVSGFSLPNYGVHWVRQPPGKGLEWLGVIWSGGNTDYNTVFKARL
SITKDNSKSQVFFKMNSLQADDTAIYYCARNLYGNYDYAMDYWGQGTSVTVSS

252C10F6-VL
                                                              (SEQ ID NO: 588)
DIVMTQSPATLSVTPGDRVSLSCRASQSISDYLHWYQQKSHESPRLLIKYASQSIS-
GIPSRFSGSGSGSEF
TLSINSVEPEDVGVYYCQNGHSFPFTFGSGTKLEIK

256C3D3-VH
                                                              (SEQ ID NO: 589)
QAYLQQSGAELVRSGASVKMSCKASGYAFTSHNMHWVKQTPGQGLEWIGYISPGNGYTNYNQKFR
GKATLTADTSSSTAYMQIGSLTSEDSAVYFCTRDYYGNSFAYWGQGTLVTVSA

256C3D3-VL
                                                              (SEQ ID NO: 590)
DIVMTQSPSSLTEKAGERVSMSCKSSQSLFNSGNQKNYLTWYQQKPGQPPKLLIYWASTRESGVPDRF
TGSGSGTDFTLTISSVQAEDLAVYYCQNNYWFPFTFGAGTKLELK

258D11C4-VH
                                                              (SEQ ID NO: 591)
QAYLQQSGAELVRSGASVKMSCKASGYTFSSHNMHWVKQTPGQGLEWIGYIYPGNGGTNYNQKFK
GKATLTADTSSSTAYMQISSLTSEDSAVYFCTRDYYGNSFAYWGQGTLVTVSA

258D11C4-VL
                                                              (SEQ ID NO: 592)
DIVMTQSPSSLTEKAGERVSMSCKSSQSLFNSGNQKNYLTWYQQKPGQPPKLLIYWASTRQSGVPDR
FTGSGSGTDFTLTISSVQAEDLAVYYCQNDYWFPFTFGAGTKLELK

259B4D4-VH
                                                              (SEQ ID NO: 593)
EIQLQQSGPELMKPGASVRISCKASGYSFTSYYMHWMKQSHVKSLEWIGYIDPFNGNTRYNQKFKDK
ATLTVDKSSTTAYMHLSSLTSEDSAVYFCASLRFFAYWGQGTLVTVSA

259B4D4-VL
                                                              (SEQ ID NO: 594)
DIVMTQSPSSLTVTAGEKVTMSCNSSQSLLNSGNQKNYLTWYQQKPGQPPKLLIYWASSRESGVPDR
FTGSGSGTDFTLTISTVQAEDLAVYYCQNDYSFPLTFGAGTRLELK
```

-continued

259C6F7-VH (SEQ ID NO: 595)
QAYLQQSGAELVRSGASVKMSCKASGYTFSSHNIHWVKQTPGQGLEWIGYIYPGNGDTNYNQKFKG
KATLTADTSSSTAYMQISSLTSEDSAVYFCARDYYGNSFVYWGQGTLVTVSA

259C6F7-VL (SEQ ID NO: 596)
DIVMIQSPSSLTEKAGEKVSMSCKSSQSLLNSGNQKNYLTWYQQKPGQPPKLLIYWASTRESGVPDRF
TGSGSGTDFTLTISSVQAEDLAVYYCQNAYRFPFTFGAGTKLELK

262H9H6-VH (SEQ ID NO: 597)
QAYLQQSGAELVRSGASVKMSCKASGYTFTSHNMHWVKQTPGQGLEWIGYISPGNGYTNYNQKFR
GKATLTADTSSSTAYMQISSLTSEDSAVYFCTRDYYGNSFTYWGQGTLVTVSA

262H9H6-VL (SEQ ID NO: 598)
DIVMTQSPSSLTEKAGERVSMSCKSSQSLENSGNQKNYLTWYQQKPGQPPKLLIYWASTRESGVPDRF
TGSGSGTEFTLTISSVQAEDLAVYYCQNNYWFPFTFGAGTKLELK

263E9F3-VH (SEQ ID NO: 599)
EIQVQQSGPELMKPGASVKISCRSSGYSFTSYYIHWVKQSRGKSLEWIGYIDPFSGGTRYNQKFEGKA
TLTVDKSSTTAYMHLSSLTSEDSAVYYCASLRFFAYWGQGTLVTVSA

263E9F3-VL (SEQ ID NO: 600)
DIVMTQSPSSLTVTAGEKVTMTCKSSQSLLNSGNQENYLTWYQQKPGQPPELLISRASTRQSGVPDRF
TGSGSGTDFTLTISSVQTEDLAVYYCQNDYSYPLTFGAGTKLELK

266B11F7-VH (SEQ ID NO: 601)
QVQMKESGPGLVAPSQSLSITCTVSGFSLTTYGVTWVRQPPGKGLEWLGVIWGDGSTNYHSALTSRL
RISKDKSKSQVFLKLSSLQTDDTATYYCAKPGRGNALDYWGQGTSVTVSS

266B11F7-VL (SEQ ID NO: 602)
DIVMTQSPSSLTVTAGEKVTMRCKSSQSLLNSGNQKNYLTWYQQKPGQPPKLLVYWASTRESGVPD
RFTGSGSGTDFTLTVSSVQAEDLAVYYCQNDYIFPLTFGAGTKLELK

267B2C5-VH (SEQ ID NO: 603)
QVQLKESGPGLVAPSQSLAITCTVSGFSLTTYGVSWVRQPPGKGLEWLGVIWGDGSTHYHSALISRLS
IRKDNSKSQVFLKVNSLQTDDTATYYCGKPGRGNAMDYWGQGTSVTVSS

267B2C5-VL (SEQ ID NO: 604)
DIVMTQSPSSLTVTAGEKVTMSCKSSQSLLNSGNQKNYLTWYQQKPGQSPKLLIYWASTRESGVPDR
FTGSGSGTDFTLTISSVQAEDLAVYYCQNDYIYPLTFGGGTTLELK

267H5F12-VH (SEQ ID NO: 605)
QAYLQQSGAELVRSGASVKMSCKASGYTFTSHNMHWVKQTPGQGLEWIGYISPGNGYTNYNQKFR
GKATLTADTSSSTAYMQISSLTSEDSAVYFCTRDYYGNSFTYWGQGTLVTVSA

267H5F12-VL (SEQ ID NO: 606)
DIVMTQSPSSLTEKAGERVSMSCKSSQSLFNSGNQKNYLTWYQQKPGQPPKLLIYWASTRESGVPDRF
TGSGSGTEFTLTISSVQAEDLAVYYCQNNYWFPFTFGAGTKLELK

273F3D4-VH (SEQ ID NO: 607)
QVQLKESGPGLVAPSQSLSITCTVSGFALTTYGVSWVRQPPGKGLEWLGVIWGDGSTHYHSALISRLS
IRKDNSKSQVFLKLNSLQTDDTATYYCAKPGRGNAMDYWGQGTSVTVSS

273F3D4-VL (SEQ ID NO: 608)
DIVMSQSPSSLTVTAGEKVTMSCKSSQSLLNSGNQKNYLTWYQQKPGQSPKLLIYWASTRESGVPDR
FTGSGSGTDFTLTISSMQAEDLAVYYCQNDYIYPLTFGAGTMLELK

275B2G2-VH (SEQ ID NO: 609)
EVMLVESGGGLVKPGGSLKLSCAASGFTFRDYTMSWVRQTPEKRLEWVATSIIGGTYTYYPDSVKGR
FTISRDNVKNTLYLQMSSLRSEDTAMYYCSRLGRGNAMDYWGQGTSVTVSS

-continued

275B2G2-VL
(SEQ ID NO: 610)
DIVMTQSPSSLTVTAGEKVTMSCKSSQSLLNSGNQKNYLTWYQQKPGQPPKLLIYWASTRESGVPDR
FTGSGSGTDFTLTISSVQAEDLAVYYCQNDYSYPFTFGSGTKLEIK

277F1F8-VH
(SEQ ID NO: 611)
QAYLQQSGPELVRSGASVKMSCKASGYTFTSHNMHWVKQTPGQGLEWIGYINPGNGGNNYNQKFK
GKATLTADTSSSTAYMQISSLTSEDSAVYFCARDYYGNSFAFWGQGTLVTVSA

277F1F8-VL
(SEQ ID NO: 612)
DIVMTQSPSSLTETAGEKVSMSCKSSQSLLNSGNQKNYLTWYQQKPGQPPKLLIYWASTRESGVPDRF
TGSGSGTDFTLTISSVQAEDLAVYYCQNDYRFPFTFGAGTKLELK

286C7F11-VH
(SEQ ID NO: 613)
QVQLKESGPGLVAPSQSLSITCTVSGFSLTDYGVSWIRQPPGKGLEWLGVIWNRGNTYYNSALKSRLS
ISKDNSKSQVFLRMNSLQTDDTAMYYCAKHDFLRFLDYWGQGTTLTVSS

286C7F11-VL
(SEQ ID NO: 614)
DVVMTQSPSSLTVTAGEKVTMSCKSSQSLLNSGNQKNYLTWYQQKPGQPPKILIYWASTRESGVPDR
FTGSGSGTDFSLTITSVQAEDLAVYYCLNDYYYPLTFGAGTKLELK

292D9C7-VH
(SEQ ID NO: 615)
QVQLKESGPGLVAPSQSLSITCTVSGFSLTDYGVSWIRQPPGKGLEWLGVIWGGGNAYYNSALKSRLS
ISKDNSKSQVFLKMNSLRTDDTAMYYCAKNGLLRYLDYWGQGSTLTVSS

292D9C7-VL
(SEQ ID NO: 616)
DTVMTQSPSSLTVTAGEKVTMSCKSSQSLLNSGNQKNYLTWYQQKPGQPPKLLIYWASTRESGVPDR
FTGSGSGRDFTLTISSVQVEDLAIYYCQNDYYYPLTFGAGTKVELK

392A11C8-VH
(SEQ ID NO: 617)
DVQLVESGGGLVQPGGSRKLSCAASGFTFSGFGMHWIRQTPEKGLEWVAYISSGSRPIYYADTVKGR
FTISRDNPKNTLFLQMTSLRSEDTAMYFCARFYYGNSFDHWGQGTLVTVSA

392A11C8-VL
(SEQ ID NO: 618)
DIVMTQSPSFLTVTAGEKVTMSCRSSQSLLNSGNQKNYLTWYQQKPGQPPKLLIYWASTRESGVPDR
FTGSGSGTDFTLTISSVQAEDLALYYCQNAYSFPLTFGAGTKLELK

392C2F10-VH
(SEQ ID NO: 619)
EVQLQQSGPELVKPGASMKISCKASGYSFTGYTMNWVKQSLGKNLEWIGLINPENGGTTYNQKFKG
KATLTVDKSSSTAYMELLSLTSDDSAVYYCTRGDYWGQGTTLTVSS

392C2F10-VL
(SEQ ID NO: 620)
DIVMTQSPSSLTVTAGEKVTMSCKSSQSLLNSGNQKNYLTWYQQKPGQPPKLLIYWASTRESGVPDR
FAGSGSGTDFTLTISSVQAEDLAVYYCQSDYSYPTFGAGTKLELK

394C2G5-VH
(SEQ ID NO: 621)
DVQLVESGGGLVQPGGSRKLSCAASGFTFSGFGMHWIRQTPEKGLEWVAYVSSGSRPIYYADTVKGR
FTISRDNPKNTLFLQMTSLRSEDTAMYFCARFYYGNSFDHWGQGTLVTVSA

394C2G5-VL
(SEQ ID NO: 622)
DIVMTQSPSFLTVTAGEKVTMSCKSSQSLLNSGNQKNYLTWYQQKPGQPPKLLIYWASTRESGVPDR
FTGSGSGTDFTLTINNVQAEDLALYYCQNAYSFPLTFGAGTKLELT

405G8F11-VH
(SEQ ID NO: 623)
DVQLVESGGGLVQPGGSRKLSCVTSGFTFSSFGMHWVRQAPEKGLEWVAYISSGSSPIYYADTVKGR
FTISRDNPKNTLFLQMSSLRSEDTAMYFCARFYYGNSFAYWGQGTLVTVSA

405G8F11-VL
(SEQ ID NO: 624)
DIVMTQSPSSLTVTAGEKVTMNCKSSQSLLNSGNQKNYLTWYQQKLGQPPKLLMYWASTRESGVPD
RFTGSGSGTDFTLTISSVQAEDLAVYFCQSAFSYPLTFGAGTKLELK

-continued

406G3C4-VH
(SEQ ID NO: 625)
EIQLQQSGPELMKPGASVRISCKASGYSFISYYIYWVKQSHGKGLEWIGYIDPFNGNTNYNQKFKGKA
TLTVDRSSSTAYIHLNSLTSEDSAVYYCAIVNGYGRGAMDYWGQGTSVTVSS

406G3C4-VL
(SEQ ID NO: 626)
QIVLTQSPAIMSASPGEKVTMTCSASSSISYMHWYQQKSGTSPKRWIYDTSKLASGVPARFSGSGSGTS
YSLTISSMEAEDAATYYCQQWSSNPLTFGDGTKLELK

407A8G10-VH
(SEQ ID NO: 627)
DVQLVESGGGLVQPGGSRKLSCAASGFTFSGFGMHWIRQTPEKGLEWVAYISSGSRPIYYADTVKGR
FTISRDNPKNTLFLQMTSLRSEDTAMYFCARFYYGNSFDHWGQGTLVTVSA

407A8G10-VL
(SEQ ID NO: 628)
DIVMTQSPSFLTVTAGEKVTMSCRSSQSLLNSGNQRNYLTWYQQKPGQPPKLLIYWASTRESGVPDR
FTGSGSGTDFALTISSVQAEDLALYYCQNAYSFPLTFGAGTKLELK

407E11H8-VH
(SEQ ID NO: 629)
DVQLVESGGGLVQPGGSRKLSCAASGFTFSDFGMHWIRQTPEKGLEWVAYISSGSRPIYYADTVKGR
FTISRDNPKNTLFLQMTSLRSEDTAMYFCVRFYFGNSFDHWGQGTLVTVSA

407E11H8-VL
(SEQ ID NO: 630)
DIVMTQSPSFLTVTAGEKVTMTCRSSQNLLNSGNLKNYLTWYQQKPGQPPKLLISWASTRESGVPDR
FTGSGSGTDFTLTISSVQPEDLALYYCQNAYSFPLTFGAGTKLELK

407H12E6-VH
(SEQ ID NO: 631)
DVQLVESGGGLVQPGGSRKLSCAASGFTVSSFGMHWVRQAPEKGLEWVAYISSGSSPIYYADTVKGR
FTISRDNPKNTLFLQMTSLRSEDTAIYFCARFYYGNSFDHWGQGTLVTVSA

407H12E6-VL
(SEQ ID NO: 632)
DIVMTQSPSSLTVTTGEKVTMSCKSSQSLLNSGNQKNYLTWYQQKPGQSPKLLIYWASTRESGVPDR
FTGSGSGTDFTLTISSVQTEDLAVYFCQNNYFFPLTFGAGTKLELK

409D1A7-VH
(SEQ ID NO: 633)
DVQLVESGGGLVQPGGSRKLSCAASGFTFSGFGMHWIRQTPEKGLEWVAYISSGSRPIYYADTVKGR
FTISRDNPKNTLFLHMTSLRSEDTAMYFCARFYYGNSFDHWGQGTLVTVSA

409D1A7-VL
(SEQ ID NO: 634)
DIVMTQSPSFLTVTAGEKVTMNCKSSQSLLNSGNQRNYLTWYQQKPGQPPKLLIYWASTRESGVPDR
FTGSGSGTDFTLTISSVQAEDLALYYCQNAYSFPLTFGAGTKLELN

409G10G6-VH
(SEQ ID NO: 635)
DVQLVESGGGLVQPGGSRKLSCAASGFTFSGFGMHWIRQTPEKGLEWVAYISSDSRPIYYADTVKGR
FTISRDNPKNTLFLQMTSLRSEDTAMYFCGRFYYGNSFDHWGQGTLVTVSA

409G10G6-VL
(SEQ ID NO: 636)
DIVMTQSPSFLTVTAGEKVTLSCRSSQSLLNSGNQRNYLTWYQQKPGQPPKLLIYWASTRESGVPDRF
TGSGSGTDFTLTISSVQAEDRALYYCQNAYSFPLTFGTGTKLELR

411A6E3-VH
(SEQ ID NO: 637)
DVQLVESGGGLVQPGGSRKLSCAASGFTFSDFGMHWIRQTPEKGLEWVAYISSGSRPIYYADTVKGR
FTISRDNPKNTLFLQMTSLRSEDTAMYFCVRFYFGNSFDHWGQGTLVTVSA

411A6E3-VL
(SEQ ID NO: 638)
DIVMTQSPSFLTVTAGEKVTMTCRSSQNLLNSGNLKNYLTWYQQKPGQPPKLLISWASTRESGVPDR
FTGSGSGTDFTLTISSVQPEDLALYYCQNAYSFPLTFGAGTKLELK

411B4G4-VH
(SEQ ID NO: 639)
DVQLVESGGGLVQPGGSRKLSCAASGFTFSGFGLHWIRQTPEKGLEWVAYISSGSRPIYYADTVKGRF
TISRDNPKNTLFLQMTSLRSEDTAMYFCARFYYGNSFDHWGQGTLVTVSA

-continued

411B4G4-VL (SEQ ID NO: 640)
DIVMTQSPSFLTVTAGEKVTMSCRSSQSLLNSGNQRNYLTWYQQKPGQPPKLLIYWASTRESGVPDR
FTGSGSGTDFTLTISSVQAEDLALYYCQNAYSFPLTFGAGTKLELK

411G3E10-VH (SEQ ID NO: 641)
DVQLVESGGGLVQPGGSRKLSCAASGFTFSGFGMHWIRQTPEKGLEWVAYISSGSRPIYYADTVKGR
FTISRDNPKNTLFLQMTSLRSEDTAMYFCARFYYGNSFDHWGQGTLVTVSA

411G3E10-VL (SEQ ID NO: 642)
DIVMTQSPSFLTVTAGEKVTMNCRSSQSLLNSGNQKNYLTWYQQKPGQPPKLLIYWASTRESGVPDR
FTGSGSGTDFTLTISSVQAEDLALYYCQNAYSFPLTFGAGTKLELK

413B1C9-VH (SEQ ID NO: 643)
DVQLVESGGGLVQPGGSRKLSCAASGFTFSSFGMHWVRQAPEKGLEWVAYISSGSSPIYYADTVKGR
FTISRDNPKNTLFLQMTSLRSEDTAMYFCARFYYGNSFDHWGQGTLVTVSA

413B1C9-VL (SEQ ID NO: 644)
DIVMTQSPSSLTVTTGEKVSMSCKSSQSLFNRGNQKSYLTWYQQKPGQPPKLLIYWASTRESGVPDRF
TGSGSGTDFTLTISSVQAEDLAVYYCQNNYIYPLTFGAGTKLELK

413C12F8-VH (SEQ ID NO: 645)
DVQLVESGGGLVQPGGSRKLSCAASGFTFSGFGVHWIRQTPEKGLEWVAYIGSGSRPIYYADTVKGR
FTISRDNPKNTLFLQMTSLRSEDTAMYFCARFYYGNSFDHWGQGTLVTVSA

413C12F8-VL (SEQ ID NO: 646)
DIVMTQSPSFLTVTAGEKVTMNCRSSQSLLNSGNQKNYLTWYQQRPGQPPKLLIYWASTRESGVPDR
FTGSGSGTDFTLTISSVQAEDLALYYCQNAYSFPLTFGAGTKLELK

413H4G12-VH (SEQ ID NO: 647)
EVQLQQSGPELVKPGASMKISCKASGYSFTGYTMNWVKQSLGKNLEWIGLINPFNGGTTYNQKFKG
KATLTVDKSSSTAYMELLSLTSDDSAVYYCTRGDYWGQGTTLTVSS

413H4G12-VL (SEQ ID NO: 648)
DIVMTQSPSSLTVTAGEKVTMSCKSSQSLLNSGNQKNYLTWYQQKPGQPPKLLIYWASTRESGVPDR
FAGSGSGTDFTLTISSVQAEDLAVYYCQSDYSYPTFGAGTKLELK

418B11D3-VH (SEQ ID NO: 649)
EIQLQQSGPELMKPGASVRISCKASGYSFISYYMYWVKQSHGKGLEWIGYIDPFNGNTNYNQKFKGK
ATLTVDRSSSTAYIHLSSLTSEDSAVYYCAIVNGYGRGAMDYWGQGTSVTVSS

418B11D3-VL (SEQ ID NO: 650)
QIVLTQSPAIMSASPGEKVTMTCSASSSISYMHWYQQKSGTSPKRWIYDTSKLASGVPARFSGSGSGTS
YSLTISSMEAEDAATYYCQQWSSNPLTFGDGTKLELK

418B8B10-VH (SEQ ID NO: 651)
DVQLVESGGGLVQPGGSRKLSCAASGFTFSSFGMHWVRQAPEKGLEWVAYISSGSSPIYYTDTVKGR
FTISRDNPKNTLFLQMTSLRSEDTAMYFCARFYYGNSFDHWGQGTLVTVSA

418B8B10-VL (SEQ ID NO: 652)
DIVMTQSPSSLTVTAGEKVSMSCKSSQSLFNRGNQKSYLTWYQQRPGQPPKLLIYWASTRESGVPDRF
TGSGSGTDFTLTISSVQAEDLAVYYCQNNYIYPLTFGAGTKLELK

419A10D4-VH (SEQ ID NO: 653)
DVQLVESGGGLVQPGGSRKLSCAASGFTFSGFGMHWIRQTPEKGLEWVAYISSGSRPIYYADTVKGR
FTISRDNPKNTLFLQMTSLRSEDTAMYFCARFYYGNSFDHWGQGTLVTVSA

419A10D4-VL (SEQ ID NO: 654)
DIVMTQSPSFLTVTAGEKVTMSCKSSQSLLNSGNQRNYLTWYQQKPGQPPKLLIYWASTRESGVPDR
FTGSGSGTDFTLTVSSVQAEDLALYYCQNAYSFPLTFGAGTKLELK

-continued

419A5F3-VH (SEQ ID NO: 655)
DVQLVESGGGLVQPGGSRKLSCAASGFTFSGFGMHWIRQTPEKGLEWVAYISSDSRPIYYADTVKGR
FTISRDNPKNTLFLQMTSLRSEDTAMYFCGRFYYGNSFDHWGQGTLVTVSA

419A5F3-VL (SEQ ID NO: 656)
DIVMTQSPSFLTVTAGEKVTLSCRSSQSLLNSGNQRNYLTWYQQKPGQPPKLLIYWASTRESGVPDRF
TGSGSGTDFTLTISSVQAEDRALYYCQNAYSFPLTFGTGTKLELR

420D5H5-VH (SEQ ID NO: 657)
DVQLVESGGGLVQPGGSRKLSCAASGFTLSGFGMHWIRQTPEKGLEWVAYISSGSRPIYYVDTVEGR
FTISRDNPKNTLFLQMTSLRSEDTAMYFCARFYYGNSFDHWGQGTLVTVSS

420D5H5-VL (SEQ ID NO: 658)
DIVMTQSPSFLTVTAGEKVTMSCKSSQSLLNSGNQKNYLTWYQQKPGQPPKLLIYWASTRESGVPDR
FTGSGSGTDFTLTIRGVQAEDLALYYCQNAYSFPLTFGAGTKLELK

420F12G8-VH (SEQ ID NO: 659)
DVQLVESGGGLVQPGGSRKLSCAASGFAFSGFGMHWIRQTPEKGLEWVAYISSGSRPIYYADTVKGR
FTISRDNPKNTLFLQMTSLRSEDTAMYFCVRFYYGNSFDHWGQGTLVTVSA

420F12G8-VL (SEQ ID NO: 660)
DIVMTQSPSFLTVTAGEKVTMTCRSSQNLLNSGNQKNYLTWYQQKPGQPPKLLISWASTRESGVPDR
FTGSGSGTDFTLTISSVQPEDLALYYCQNAYSFPFTFGAGTKLELK

420H7E6-VH (SEQ ID NO: 661)
DVQLVESGGGLVQPGGSRKLSCVTSGFTFSSFGMHWIRQAPEKGLEWVAFISGGGSPIFYADSVKGRF
TVSRDNPKNTLFLQMTGLRSEDTAMYFCARFYFGNSFAYWGQGTLVTVSA

420H7E6-VL (SEQ ID NO: 662)
DIVMAQSPSSLTVTAGEKVTMNCRSSQSLFNSGNQKNYLTWYQQKPGQPPKLLIYWASTRESGVPVR
FTGSGSGTDFTLTISSVQAEDLAVYYCQTGFSYPLTFGPGTKLELK

421H4G3-VH (SEQ ID NO: 663)
DVQLVESGGGLVQPGGSRKLSCAASGFSFSGFGLHWIRQTPEKGLEWVAYISSGSRPIYYADTVKGRF
TISRDNPKNTLFLQMTSLRSEDTAMYFCARFYFGNSFDHWGQGTLVTVST

421H4G3-VL (SEQ ID NO: 664)
DIVMTQSPSFLTVTAGEKVTMSCRSSQSLLNSGNQRNYLTWYQQKPGQPPKLLIYWASTRESGVPDR
FTGSGSGTDFTLTINSVQAEDLALYYCQNAYSFPLTFGAGTKLELK

423B2B5-VH (SEQ ID NO: 665)
DVQLVESGGGLVQPGGSRKLSCAASGFTFSSFGMHWVRQAPEKGLEWVAYISSGSSPIYYSDTVKGR
FTISRDNPKNTLFLQMSSLRSEDTAMYFCARIYYGNSFDHWGQGTLVTVSA

423B2B5-VL (SEQ ID NO: 666)
DIVMTQSPSSLTVTAGEKVTMNCKSSQSLLNSGNQKNYLTWYQQKPGQPPKLLIYWASTRESGVPDR
FTGSGSGTDFTLTISSVQAEDLAVYYCQNDYSYPLTFGAGTKLELK

423C10E1-VH (SEQ ID NO: 667)
DVQLVESGGGLVQPGGSRKLSCVTSGFTFSSFGMHWVRQAPEKGLEWVAFISGGGSPIFYADSVKGR
FTVSRDNPKNTLFLQMTGLRSEDTAMYFCARFYFGNSFAYWGQGTLVTVSA

423C10E1-VL (SEQ ID NO: 668)
DIVMTQSPSSLTVTAGEKVTMNCRSSQSLFNSGNQKNYLTWYQQKPGQSPKLLIYWASTRESGVPVR
FTGSGSGTDFTLTISSVQAEDLAVYYCQTSFNYPLTFGPGTKLELK

424G9G3-VH (SEQ ID NO: 669)
QVQLQQSGPEVVRPGASVKMSCKGSGYTLNNFWMHWVKQRPGQGLEWIGMIDTSNGETRLNQIFK
DKATLTVDKSSKTAYMQLSSLTSEDSAVYYCAPYGNFADWGQGTTLTVSS

```
424G9G3-VL
                                                      (SEQ ID NO: 670)
DVLLTQTPLSLPVSLGDQASISCRSSQSIVYGNGNTYLEWYLQKPGQSPKLLIYKVSSRFSGVPDRFSG
SGSGTDFTLKITKVEAEDLGVYYCFQGSHVPFTFGSGTKLEIK

426D9F6-VH
                                                      (SEQ ID NO: 671)
DVQLVESGGGLVQPGGSRKLSCAASGFTFSGFGMHWIRQTPEKGLEWVAYISSGSRPIYYADTVKGR
FTISRDNPKNTLFLQMTSLRSEDTAMYFCARFYYGNSFDHWGQGTLVTVSA

426D9F6-VL
                                                      (SEQ ID NO: 672)
DIVMTQSPSFLTVTAGEKVTMSCKSSQSLLNSGNQRNYLTWYQQKPGQPPKLLIYWASTRESGVPDR
FTGSGSGTDFTLTVSSVQAEDLALYYCQNAYSFPLTFGAGTKLELK

427C7H2-VH
                                                      (SEQ ID NO: 673)
QVQLQQPGSELVRPGASVKLSCKASGYTFTSYWMHWVKQRPGQGLEWIGNIYPGSGSTNYDEKFKS
KATLTVDTSSSTAYMQLSSLTSEDSAVYYCTRRITTATRDYFDYWGQGTTLTVSS

427C7H2-VL
                                                      (SEQ ID NO: 674)
EIVLTQSPALMAASPGEKVTITCSVSSSISSSNLHWYQQKSETSPKPWIYGTSNLASGVPVRFSGSGSGT
SYSLTISSMEAEDAATYYCQQWSSYPLTFGGGTKLEIK

430A11H9-VH
                                                      (SEQ ID NO: 675)
DVKLVESGGGLVKPGGSLKLSCAASGFTFSSYTMSWVRQTPEKRLEWVATISSGGSYTYYPDSVKGR
FTISRDNAKNTLYLQMSSLKSEDTAMYYCTRDPGYFAYWGQGTLVTVSA

430A11H9-VL
                                                      (SEQ ID NO: 676)
DIQMTQSPASLSASVGETVTITCRASENIYSYLAWYQQKQGKSPQLLVYNAKTLAEGVPSRFSGSGSG
TQFSLKINSLQPEDFGSYYCQHHYGTPYTFGGGTKLEIK

430B3F1-VH
                                                      (SEQ ID NO: 677)
DVQLVESGGGLVQPGGSRKLSCAASGFTFSGFGMHWIRQTPEKGLEWVAYISSGGRPIYYADTVQGR
FTISRDNPKNTLFLQMTSLRSEDTAMYFCARFYYGNSFDHWGQGTLVTISS

430B3F1-VL
                                                      (SEQ ID NO: 678)
DIVMTQSPSFLTVTAGEKVTMSCKSSQSLLNSGNQKNYLTWYQQKPGQPPKLLIYWASTRESGVPDR
FTGSGSGTDFTLTISSVQAEDLALYYCQNAYSFPLTFGAGTKLELK

279E8B8-VH
                                                      (SEQ ID NO: 679)
QAYLQQSGAELVRSGASVKISCKASGYTFASHNMHWVKQTPGQGLEWIGYIYPGNGGTKYNQKFTG
KATLSADTSSSTAYLQISSLTSEDSAVYFCARDYFGNSFVYWGQGTLVTVSA

279E8B8-VL
                                                      (SEQ ID NO: 680)
DIVMTQSPSSLTEKAGEKVSMRCKSSQSLLNSGNQKNYLTWYQQKPGQPPKLLIYWASTRESGVPDR
FTGSGSGTDFTLTISSVQADDLAVYYCQNDYMYPFTFGAGTKLELK

CD8α signal peptide
                                                      SEQ ID NO: 291
MALPVTALLLPLALLLHAARP CD8α hinge
                                                      SEQ ID NO: 292
TTTPAPRPPTPAPTIASQPLSLRPEACRPAAGGAVHTRGLDFACD CD8α transmembrane domain
                                                      SEQ ID NO: 293
IYIWAPLAGTCGVLLLSLVITLYC 4-1BB (CD137) cytoplasmic domain
                                                      SEQ ID NO: 294
KRGRKKLLYIFKQPFMRPVQTTQEEDGCSCRFPEEEEGGCEL CD28 cytoplasmic domain
                                                      SEQ ID NO: 295
RSKRSRLLHSDYMNMTPRRPGPTRKHYQPYAPPRDFAAYRS
```

CD3ζ (CD3z) cytoplasmic domain
SEQ ID NO: 296

RVKFSRSADAPAYQQGQNQLYNELNLGRREEYDVLDKRRGRDPEMGGKPRRKNPQEGLYNELQKD
KMAEAYSEIGMKGERRRGKGHDGLYQGLSTATKDTYDALHMQALPPR

Linker 1
SEQ ID NO: 297

GSTSGSGKPGSGEGSTKG

Linker 2
SEQ ID NO: 298

TS

Amino acid sequence of anti-Claudin18.2 CAR
C182001 amino acid sequence
SEQ ID NO: 299

MALPVTALLLPLALLLHAARPDIVMTQSHKFMSTSVGDRVSITCKASQDVSTAVAWYQQKPGQSPKL
LIYSASYRYTGVPDRFTGSGSGTDFTFTISSVQAEDLAVYYCQQHYSTPRTFGGGTKLEIKGSTSGSGK
PGSGEGSTKGQVQLQQSGAELMKPGASVKISCKATGYTFSSYWIEWVKQRPGHGLEWIGEILPGSGST
NYNEKFKGKATFTADTSSNTAYMQLSSLTSEDSAVYYCARYGGLRRYFDYWGQGTTLTVSSTSTTTP
APRPPTPAPTIASQPLSLRPEACRPAAGGAVHTRGLDFACDIYIWAPLAGTCGVLLLSLVITLYCKRGR
KKLLYIFKQPFMRPVQTTQEEDGCSCRFPEEEEGGCELRVKFSRSADAPAYQQGQNQLYNELNLGRR
EEYDVLDKRRGRDPEMGGKPRRKNPQEGLYNELQKDKMAEAYSEIGMKGERRRGKGHDGLYQGLS
TATKDTYDALHMQALPPR

C182002 amino acid sequence
SEQ ID NO: 300

MALPVTALLLPLALLLHAARPDIVMTQSPSSLTVTVGEKVTMSCKSSQSLLNSGNQKNYLTWYQQKP
GQPPKLLIYWASTRESGVPDRFTGSGSETDFTLTISSLQAEDLAVYYCQNSYSFPLTFGGGTNLEIKGST
SGSGKPGSGEGSTKGQIQLVQSGPELKKPGETVRISCKASGYTFTTAGMQWVQKMPGKGLKWIGWIN
THSRVPNFAEDFKGRFAFSLETSARIAYLQISNIKNEDMATYFCARLGKGNTMDFWGQGTSVTVSSTS
TTTPAPRPPTPAPTIASQPLSLRPEACRPAAGGAVHTRGLDFACDIYIWAPLAGTCGVLLLSLVITLYCK
RGRKKLLYIFKQPFMRPVQTTQEEDGCSCRFPEEEEGGCELRVKFSRSADAPAYQQGQNQLYNELNL
GRREEYDVLDKRRGRDPEMGGKPRRKNPQEGLYNELQKDKMAEAYSEIGMKGERRRGKGHDGLYQ
GLSTATKDTYDALHMQALPPR

C182003 amino acid sequence
SEQ ID NO: 301

MALPVTALLLPLALLLHAARPDIVMTQSPSSLTVTAGEKVTMSCKSSQSLLNSGNQKNYLTWYQQKP
GQPPKLLIYWASTRESGVPDRFTGSGSGTDFTLTISSVQAEDLAVYSCQNAYSYPFTFGAGTKLELKGS
TSGSGKPGSGEGSTKGEVQLQQSGTVLARPGTSVKMSCKASGYRFTSSWMHWVKQRPGQGLEWIGA
NYPGKSDTTYTQKFKGKARLTAVTSASTAYMELSSLTNEDSAVYYCARGAYYGNAMDYWGQGTSV
TVSSTSTTTPAPRPPTPAPTIASQPLSLRPEACRPAAGGAVHTRGLDFACDIYIWAPLAGTCGVLLLSLV
ITLYCKRGRKKLLYIFKQPFMRPVQTTQEEDGCSCRFPEEEEGGCELRVKFSRSADAPAYQQGQNQLY
NELNLGRREEYDVLDKRRGRDPEMGGKPRRKNPQEGLYNELQKDKMAEAYSEIGMKGERRRGKGH
DGLYQGLSTATKDTYDALHMQALPPR

C182004 amino acid sequence
SEQ ID NO: 302

MALPVTALLLPLALLLHAARPDIVMTQSPSSLTVTAGEKVTMSCKSSQSLFNSGNLKNYLTWYQQKP
GQPPKLLICWASTRESGVPDRFTGSGSGTEFTLTISSVQAEDLAVYYCQNDYSYPFTFGSGTKLEIKGS
TSGSGKPGSGEGSTKGQVQLKESGPGLVAPSQSLSITCTVSGFSLTDYGVSWIRQPPGKGLEWLGVIW
GGGSTYYNSALKSRLIISKDNSKSQVFLKMNSLQTDDTAIYYCAKHYGNACDYWGQGTTLTVSSTS
TTTPAPRPPTPAPTIASQPLSLRPEACRPAAGGAVHTRGLDFACDIYIWAPLAGTCGVLLLSLVITLYCK
RGRKKLLYIFKQPFMRPVQTTQEEDGCSCRFPEEEEGGCELRVKFSRSADAPAYQQGQNQLYNELNL
GRREEYDVLDKRRGRDPEMGGKPRRKNPQEGLYNELQKDKMAEAYSEIGMKGERRRGKGHDGLYQ
GLSTATKDTYDALHMQALPPR

C182005 amino acid sequence
SEQ ID NO: 303

MALPVTALLLPLALLLHAARPDIVLTQSPSSLTVTAGEKVTMSCKSSQSLLNSGNLRNYLTWYQQKP
GQPPKLLIYWASTRESGVPDRFTGSGSGTDFTLTISSLQAEDLAIYYCQNGYSYPFTFGSGTKLEIKGST
SGSGKPGSGEGSTKGEVKLVESGGGLVQPGGSRKLSCAASGFTFRDYGMAWVRQAPGKGPEWITFIS
NLAYSIYYADTVTGRFTISTENAKNTLYLEMSSLRSEDTAMYYCAVIYYGNSFAYWGQGTLVTVSAT
STTTPAPRPPTPAPTIASQPLSLRPEACRPAAGGAVHTRGLDFACDIYIWAPLAGTCGVLLLSLVITLYC
KRGRKKLLYIFKQPFMRPVQTTQEEDGCSCRFPEEEEGGCELRVKFSRSADAPAYQQGQNQLYNELN
LGRREEYDVLDKRRGRDPEMGGKPRRKNPQEGLYNELQKDKMAEAYSEIGMKGERRRGKGHDGLY
QGLSTATKDTYDALHMQALPPR

C182006 amino acid sequence
SEQ ID NO: 304

MALPVTALLLPLALLLHAARPDIVMTQSPSSLTVTAGEKVTMSCKSSQSLLNSGNQKSYLTWYQQRP
GQPPKLLIYWASTRESGVPDRFTGSGSGTDFTLTISSVQAEDLAVYFCQNVYFFPFTFGSGTKLETKGS
TSGSGKPGSGEGSTKGQVQLKESGPGLVAPSQSLSITCTVSGFSLTSYGVSWVRQPPGKGLECLGVIW

```
AGGNTNYNSALMSRLSISKDKSKSQVFLKMNSLQTDDTAMYYCARVYYGNAMDYWGQGTSVTVSS
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR

C182007 amino acid sequence
                                                  SEQ ID NO: 305
MALPVTALLLPLALLLHAARPDIVMTQSPSSLTVTPGEKVTMSCKSSQSLFNSGNQKNYLIWYQQKPG
QPPKLLIYRASTRDSGVPDRFTGSGSGTDFTLTISNVQAEDLAIYYCQNDYSYPLTFGAGTKLELKGST
SGSGKPGSGEGSTKGQAYLQQSGAELVRSGASVKMSCKASGFTFTSYNIHWVKQTPGQGLEWIGYIS
PGNGGSNYNLKFKDKATLTSATSSSTAYMQISSLTSEDSAVYFCATGRGFAYWGQGTLVTVSATSTT
TPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182008 amino acid sequence
                                                  SEQ ID NO: 306
MALPVTALLLPLALLLHAARPDIMMTQSPSSLTETAGEKVSMSCKSSQSLLNSGNQKNYLTWYQQKP
GQPPKLLIYWASTRESGVPDRFSGSGSGTDFTLTISSVQAEDLAVYYCQNGYRFPFTFGAGTKLELKGS
TSGSGKPGSGEGSTKGQAYLQQSGAELVRSGASVKMSCKASGYTFTSHNIHWIKQTPGKGLEWIGYI
YPGNGGTNYNQKFKAKATLTADTSSSTAYMQISSLTSEDSAVYFCARDYYGNSFAYWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182009 amino acid sequence
                                                  SEQ ID NO: 307
MALPVTALLLPLALLLHAARPDIVMTQSPSSLTEKVGERVSMSCKSSQSLFNSGNQKNYLTWYQQKP
GQPPKLLIYWASTRESGVPDRFTGSGSGTDFTLTISSVQAEDLAVYYCQNDYWYPFTFGAGTKLELKG
STSGSGKPGSGEGSTKGQAYLQQSGAELVRSGASVKMSCKASGYTFTSHNMHWVKQTPGQGLEWIG
YIYPGNGRTNYNQKFKGKATLTADTSSSTAYMQISSLTSEDSAVYFCTRDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR C182010 amino acid sequence
                                                  SEQ ID NO: 308
MALPVTALLLPLALLLHAARPDIVMTQSPSSLTEKAGERVSMSCKSSQSLFNSGNQKNYLTWYQQKP
GQPPKLLIYWASTRESGVPDRFTGSGSGTDFTLTISSVQAEDLAVYYCQNDYRYPFTFGAGTKLELKG
STSGSGKPGSGEGSTKGQAYLQQSGAELVRSGASVKMSCKASGYTFTSHNMHWVKQTPGQGLEWIG
YIYPGNGGTNYNYQKFKGKATLTADTSSSTAYMQINSLTSEDSAVYFCTRDYYGNSFAYWGQGTLVT
VSATSTTTPAPRPPTPAPTIASQPLSLRPEACRPAAGGAVHTRGLDFACDIYIWAPLAGTCGVLLLSLVI
TLYCKRGRKKLLYIFKQPFMRPVQTTQEEDGCSCRFPEEEEGGCELRVKFSRSADAPAYQQGQNQLY
NELNLGRREEYDVLDKRRGRDPEMGGKPRRKNPQEGLYNELQKDKMAEAYSEIGMKGERRRGKGH
DGLYQGLSTATKDTYDALHMQALPPR C182011 amino acid sequence
                                                  SEQ ID NO: 309
MALPVTALLLPLALLLHAARPDIVMTQSPSSLTVTAGEKVTMTCKSSQSLLNSGNQKNYLTWYQQKP
GQPPKVLISRASTRQSGVPDRFTGSGSGTDFTLTISSVQAEDLAVYYCQNDYSYPLTFGAGTKLELKGS
TSGSGKPGSGEGSTKGEIQLQQSGPELMKPGASVKMSCKASGYSFTSYYIHWVKQSHGKSLEWIGYID
PFNGGTRYNQKFEGKATLTVDKSSTTAYMHLSSLTSEDSVYYCASLRFLAYWGQGTLVTVSATSTT
TPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182012 amino acid sequence
                                                  SEQ ID NO: 310
MALPVTALLLPLALLLHAARPDVVMTQSPSSLTEKTGEKVSMSCKSSQSLLNSGNQKNYLTWYQQKP
GQPPKLLIYWASTRESGVPDRFTGSGSGTDFTLTISSLQTEDLAIYYCQNNFRYPFTFGAGTKLELKGS
TSGSGKPGSGEGSTKGQTYLQQSGAELVRSGASVKMSCRTSGSFTSHNMHWVKQTPGQGLEWIGYI
YPGNGGSYYNQKFKGKAILTADTSSSTAYMQISSLTSEDSAVYFCTRDYYGNSFVYWGQGTLVTVSA
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR C182013 amino acid sequence
                                                  SEQ ID NO: 311
MALPVTALLLPLALLLHAARPDIVMTQSPSSLTEKAGEKVSMRCKSSQSLLNSGNQKNYLTWYQQKP
GQPPKLLIYWASTRESGVPDRFTGSGSGTDFTLTISSVQADDLAVYYCQNDYMFPFTFGAGTKLELKG
STSGSGKPGSGEGSTKGQADLQQSGAELVRSGASVKMSCKASGYTFASHNMHWVKQTPGQGLEWIG
```

```
YIYPGNGGTKYNQKFTGKATLTADTSSSTAYMQITSLTSEDSAVYFCARDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR

C182014 amino acid sequence
                                                     SEQ ID NO: 312
MALPVTALLLPLALLLHAARPDIVMTQSPSSLTEKAGERVSMSCKSSQSLFNSGNQKNYLTWYQQKP
GQPPKLLIYWASTRESGVPDRFTGSGSGTDFTLTISSVQAEDLAVYYCQNNYWFPFTFGAGTKLELKG
STSGSGKPGSGEGSTKGQAYLQQSGAELVRSGASVKMSCKASGYTFTSHNLHWVKQTPGQGLEWIG
YIYPGNGNTNYNQKFKGKATLTADTSSSTAYMQISSLTSEDSAVYFCTRDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR C182015 amino acid sequence
                                                     SEQ ID NO: 313
MALPVTALLLPLALLLHAARPDIVMTQSPSSLTVTAGEKVTMSCKSSQSLLNSGNQKNYLTWYQQKP
GQPPKLLIYWAATRESGVPDRFAGSGSGTDFTLTISSVQAEDLAVYYCQNDYFYPFTFGAGTKLELKG
STSGSGKPGSGEGSTKGQVQLQQSGAELVKPGASVKLSCKASGYTFTSFGINWLRQRPEQGLEWIGWI
FPGDGNSKYNENFKGKATLTTDKSSSTAYMQVTRLTSEDSAVYFCARFYYGNSFANWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182016 amino acid sequence
                                                     SEQ ID NO: 314
MALPVTALLLPLALLLHAARPDIVMTQSPSSLTVTAGEKVTMSCKSSQTLLNSGNQKNYLTWYQQKP
GQPPKLLIYWASTGESGVPDRFTGSGSGTDFTLTISSVQAEDLAVYFCQNAYFYPFTFGGGTKLEIKGS
TSGSGKPGSGEGSTKGQVQLKESGPGLVAPSQSLSITCTVSGFSLTTYGVHWVRQPPGKGLEWLGVIW
AGGSTNYNSALMSRVSINKDNSKSQVFIKMNSLQADDTALYYCARAAYYGNGLDYWGQGTTLTVSS
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR C182017 amino acid sequence
                                                     SEQ ID NO: 315
MALPVTALLLPLALLLHAARPDIVMTQSPSSLPVTAGEKVTMSCKSSQSLLNSGNQKNYLTWYQQKP
GQPPKLLIYWASTRDSGVPDRFTGSGSGTDFTLTISSVQAEDLAVYYCQNNYIYPLTFGAGTKLELKG
STSGSGKPGSGEGSTKGQVQLKQSGPGLVQPSQSLSITCTVSGFSLTRYGVHWVRQSPGKGLEWLGVI
WSGGNTDYNAAFISRLNIRKDNSKSQVFFKMNSLKPNDTAIYYCARAAYFGNSFDYWGQGTTLTVSS
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR C182018 amino acid sequence
                                                     SEQ ID NO: 316
MALPVTALLLPLALLLHAARPDIVMTQSPSSLTVTAGEKVTMSCKSSQSLLNSGNQKNYLTWYQQKP
GQPPKLLIYWASTRESGVPDRFTGSGSGTDFTLTISSVQAEDLAVYYCQNNYIYPLTFGAGTKLELKGS
TSGSGKPGSGEGSTKGQVQLKQSGPGLVQPSQSLSITCTVSGFSLTYYGVHWVRQSPGKGLEWLGVI
WRGGNTDYNAAFISRLSINKDNSKSQVFFKMNSLQPNDTAIYYCARAAYYGNCFDYWGQGTTLTVS
STSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182019 amino acid sequence
                                                     SEQ ID NO: 317
MALPVTALLLPLALLLHAARPDIVMTQSPSSLIVTPGERVTMSCKSSQSLLNSGNQKNYLTWYQQKPG
QPPKLLIYRASTRESGVPDRFTGSGSGTDFTLTISSVQAEDLAVYYCQNDYSYPLTFGIGTKLELKGSTS
GSGKPGSGEGSTKGQAYLQQSGAELVRSGASVKMSCKASGYPFTSYNMHWVKQTPGQGLEWVGYI
YPGNGGTNYNQKFRDKATLTADTSSSTAYMQISRLTSDDSAVYFCLTGRGFTYWGQGTLVTVSATST
TTPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182020 amino acid sequence
                                                     SEQ ID NO: 318
MALPVTALLLPLALLLHAARPDIVMTQSPSSLTVTAGEKVTMNCKSSQSLFNSGNQKNYLTWYQQKP
GQPPKLLIYRASTRESGVPDRFTGSGSGTDFTLTISSVQAEDLAVYYCQNDYSYPLTFGVGTKLELKGS
TSGSGKPGSGEGSTKGQAYLQQSGAELVRSGASVKMSCKASGYTFSSYNMHWVKQTPGQGLEWIGY
IYPGNGGTNYNQKFKGKATLTADTSSSTAYMQISSLTSEDSAVYFCLTGRGFTYWGQGTLVTVSATST
```

```
-continued
TTPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182021 amino acid sequence
                                                          SEQ ID NO: 319
MALPVTALLLPLALLLHAARPDIVMTQSPSSLTVTAGEKVTLSCKSSQSLFNTGNQKNYLTWYQQKP
GQPPKLLIFRASTRESGVPDRFTGSGFGTDFTLTISSVQAEDLAVYYCQNDFSYPLTFGAGTKLELKGS
TSGSGKPGSGEGSTKGQAYLQQSGAELVRSGASVKMSCKASGYTFTSYNMHWVRQTPGQGLEWIGY
IYPGNGGTNYSQKFKGKASLTADTSSTTAYMQISSLTSEDSAVYFCATGRGFAYWGQGTLVTVSATS
TTTPAPRPPTPAPTIASQPLSLRPEACRPAAGGAVHTRGLDFACDIYIWAPLAGTCGVLLLSLVITLYCK
RGRKKLLYIFKQPFMRPVQTTQEEDGCSCRFPEEEEGGCELRVKFSRSADAPAYQQGQNQLYNELNL
GRREEYDVLDKRRGRDPEMGGKPRRKNPQEGLYNELQKDKMAEAYSEIGMKGERRRGKGHDGLYQ
GLSTATKDTYDALHMQALPPR C182022 amino acid sequence
                                                          SEQ ID NO: 320
MALPVTALLLPLALLLHAARPDIVMTQFPSSLTVTAGEKVTMTCKSSQSLLNGGNQKNYLTWYQQKP
GLPPKLLIYWASTRESGVPDRFTGSGSGTEFTLTISSVQAEDLAVYYCQNNYYFPLTFGAGTKLELKGS
TSGSGKPGSGEGSTKGQIQWVQSGPELKKPRETVKISCKASGYTFTDYSMHWVKQAPGKGLKWMG
WINSETGEATYADDFRGRFALSLETSATTAFLQINSLKNEDTGYYFCARFYYGNSFASWGQGTTLTVS
STSTTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182023 amino acid sequence
                                                          SEQ ID NO: 321
MALPVTALLLPLALLLHAARPDIVMTQSPSSLTVTAGERVTMSCKSSQSLFNSGNQKNYLTWYQQKP
GQPPKLLIYRASTRESGVPDRFTGSGSGTDFTLTISSVQAEDLAVYYCQNDYSYPLTFGVGTKLELKGS
TSGSGKPGSGEGSTKGQAYLQQSGAELVRSGASVRMSCKASGYTFSSYNMHWVKQTPGQGLEWIGY
IYPGNGGTNYNQKFKDKATLTADTSSTAFIQISSLTSEDSAVYFCLTGRGFAYWGQGTLVTVSATSTT
TPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182024 amino acid sequence
                                                          SEQ ID NO: 322
MALPVTALLLPLALLLHAARPDIVMTQSPSSLTVTPGEKVTMSCKSSQSLFNSGNQKNYLIWYQQKPG
QPPKLLIYRASTRDSGVPDRFTGSGSGTDFTLTISNVQAEDLAVYYCQNDYSYPLTFGAGTKLELKGS
TSGSGKPGSGEGSTKGQTYLQQSGAELVRSGASVKMSCKASGYTFTSYNIHWVKQTPGQGLEWIGYI
SPGNGGTYYNLKFKDKATLTTATSSSTAYMQISSLTSEDSAVYFCATGRGFAYWGQGTLVTVSATST
TTTPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182025 amino acid sequence
                                                          SEQ ID NO: 323
MALPVTALLLPLALLLHAARPDIVMTQSPSSLTVTAGEKVTMSCKSSQSLLNSGNQKNYLTWYQQKP
GQPPKLLIYRASTRESGVPDRFTGSGFGTDFTLTISSVQAEDLAVYYCQNDYSYPLTFGAGTKLELKGS
TSGSGKPGSGEGSTKGQAYVQQSGAELVRSGASVKMSCRASGYTFTSYNMHWVKQTPGQGLEWIG
YIYPGNGGTYYNQKFKGKATLTADTSSSTAYMQISSLTSEDSAVYFCATGRGFAYWGQGTLVTVSAT
STTTPAPRPPTPAPTIASQPLSLRPEACRPAAGGAVHTRGLDFACDIYIWAPLAGTCGVLLLSLVITLYC
KRGRKKLLYIFKQPFMRPVQTTQEEDGCCRFPEEEEGGCELRVKFSRSADAPAYQQGQNQLYNELN
LGRREEYDVLDKRRGRDPEMGGKPRRKNPQEGLYNELQKDKMAEAYSEIGMKGERRRGKGHDGLY
QGLSTATKDTYDALHMQALPPR C182026 amino acid sequence
                                                          SEQ ID NO: 324
MALPVTALLLPLALLLHAARPDILMTQSPSSLTATAGEKVSMSCKSSQSLFNSGNQRNYLTWYQQRP
GQPPKLLIYWASTRESGVPDRFTGSGSGTDFTLTISSVQAEDLAVYYCQNDYRYPFTFGAGTKLELKG
STSGSGKPGSGEGSTKGQAYLQQSGAELVRSGASVKMSCKASGYTFTSHNMHWVKQTPGQGLEWIG
YIYPGNGGTNYNQKFKGKATLTADTSSSTAYMQISSLTSEDSAVYFCARDYFGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR C182027 amino acid sequence
                                                          SEQ ID NO: 325
MALPVTALLLPLALLLHAARPDIVMTQSPSSLTEKAGERVSMSCKSSQSLFNSGNQKNYLTWYQQKP
GQPPKLLIYWASTRESGVPDRFTGSGSGTDFTLTISSVQAEDLAVYYCQNAYWYPFTFGAGTKLELKG
STSGSGKPGSGEGSTKGQAYLQQSGAELVRSGASVKMSCKASGYTFTSHNMHWVKQTPRQGLEWIG
YIYPGNGDTNYNQKFKGKATLTADTSSSTAYMQISSLTSEDSAVYFCTRDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR
```

-continued

C182028 amino acid sequence
SEQ ID NO: 326
MALPVTALLLPLALLLHAARPDIVMSQSPSSLTVTAGEKVTMSCKSSQSLLNSGNQKNYLTWYQQKP
GQSPKLLIYWASTRESGVPDRFTGSGSGTDFTLTISSMQAEDLAVYYCQNDYIYPLTFGAGTMLELKG
STSGSGKPGSGEGSTKGQVQLKESGPGLVAPSQSLSITCTVSGFALTTYGVSWVRQPPGKGLEWLGVI
WGDGSTHYHSALISRLSIRKDNSKSQVFLKLNSLQTDDTATYYCAKPGRGNAMDYWGQGTSVTVSS
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR C182029 amino acid sequence
SEQ ID NO: 327
MALPVTALLLPLALLLHAARPDIVMTQSPSSLTEKAGERVSMSCKSSQSLFNSGSQKNYLTWYQQKP
GQPPKLLIYWASTRESGVPDRFSGSGSGTDFTLTISSVQAEDLAVYYCQNNYWFPFTFGAGTKLELKG
STSGSGKPGSGEGSTKGQAYLQQSGAELVRSGASVKMSCKASGYTFTSHNIHWVKQTPGQGLEWIGY
ISPGNGYTNYNQKFRGKATLTADTSSSTAYMQISSLTSEDSAVYFCTRDYYGNSFAYWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKHDG
LYQGLSTATKDTYDALHMQALPPR C182030 amino acid sequence
SEQ ID NO: 328
MALPVTALLLPLALLLHAARPDIVMTQSPSSLTVTAGEKVTMSCKSSQSLFNSGNQKNYLTWYQQKP
GQPPKLLIYRASTRESGVPDRFTGSGSGTDFTLTISSVQAEDLAVYYCQNDYSYPLTFGTGTKLELKGS
TSGSGKPGSGEGSTKGQAYLQQSGAELVRSGASVRMSCKASGFTFTSYNIHWVKQTPGQGLEWIGYI
YPGSGGSNYNQKFMGKATLTADTSSSTVYMQISSLTSEDSAVYFCATGRGFAYWGQGTLVTVSATST
TTPAPRPPTPAPTIASQPLSLRPEACRPAAGGAVHTRGLDFACDIYIWAPLAGTCGVLLLSLVITLYCKR
GRKKLLYIFKQPFMRPVQTTQEEDGCSCRFPEEEEGGCELRVKFSRSADAPAYQQGQNQLYNELNLG
RREEYDVLDKRRGRDPEMGGKPRRKNPQEGLYNELQKDKMAEAYSEIGMKGERRRGKGHDGLYQG
LSTATKDTYDALHMQALPPR C182031 amino acid sequence
SEQ ID NO: 329
MALPVTALLLPLALLLHAARPDIVMTQSPSSLTEKAGEKVSMRCKSSQSLLNSGNQKNYLTWYQQKP
GQPPKLLIYWASTRESGVPDRFTGSGSGTDFTLTISSVQADDLAVYYCQNDYMFPFTFGAGTKLELKG
STSGSGKPGSGEGSTKGQAYLQQSGAELVRSGASVKMSCKASGYTFASHNMHWVKQTPGQGLEWIG
YIYPGNSGTKYNQKFTGKATLTADTSSSTAYMQITSLTSEDSAVYFCARDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR C182032 amino acid sequence
SEQ ID NO: 330
MALPVTALLLPLALLLHAARPDIVMTQSPSSLTEKAGEKVSMSCKSSQSLLNSGNQKNYLTWYQQKP
GQPPKLLIYWASTRESGVPDRFTGSGSGTDFTLTISSVQAEDLAVYYCQNDYRYPFTFGAGTKLELKG
STSGSGKPGSGEGSTKGQAYLQQSGAELVRSGASVKMSCKASGYTFTSHNIHWVKQTPGQGLEWIGY
IYPGNGAPNYNQKFRGKATLTADTSSSTAYMQISSLTSEDSAVYFCARDYYGNSFVYWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182033 amino acid sequence
SEQ ID NO: 331
MALPVTALLLPLALLLHAARPDIVVTQSPSSLTVTAGEKVTMNCKSSQSLLNSGNQKNYLTWYQQKP
GQPPKLLIYWASTRESGVPDRFTGSGSGTDFTLTISSVQAEDLAIYYCQNDYYYPLTFGAGTKLELKGS
TSGSGKPGSGEGSTKGQAYLQQSGAELVRSGASVKMSCKASGYTFTNYNIHWVKQTPGQGLEWIGYI
YPGNGGNYYNQKFKGKATLTADTSSSTAYMQISSLTSEDSAVYFCARDYYGNSFAYWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182034 amino acid sequence
SEQ ID NO: 332
MALPVTALLLPLALLLHAARPDVVMTQSPSSLTEKTGEKVTMTCKSSQSLLNSGNQKNYLAWYQQK
PGQPPKLLIYWASTRESGVPDRFIGSGSGTDFTLTISSLQTEDLAVYYCQNNYMYPFTFGAGTKLELKG
STSGSGKPGSGEGSTKGQAYLQQSGAELVRSGASVKMSCRASGYTFTSHNMHWVKQTPGQGLEWIG
YIYPGNGNTYYNQKFKVKATLTADTSSNTAYMQINSLTSEDSAVYFCVRDYYGNSFVYWGQGTLVT
VSATSTTTPAPRPPTPAPTIASQPLSLRPEACRPAAGGAVHTRGLDFACDIYIWAPLAGTCGVLLLSLVI
TLYCKRGRKKLLYIFKQPFMRPVQTTQEEDGCSCRFPEEEEGGCELRVKFSRSADAPAYQQGQNQLY
NELNLGRREEYDVLDKRRGRDPEMGGKPRRKNPQEGLYNELQKDKMAEAYSEIGMKGERRRGKGH
DGLYQGLSTATKDTYDALHMQALPPR -continued C182035 amino acid sequence
SEQ ID NO: 333
MALPVTALLLPLALLLHAARPDIVMTQSPSSLTVTAGEKVTLNCRSSQSLLNSGNQKNYLTWYQQKP
GQPPKLLIYWASTRESGVPDRFTGSGSGTDFTLTISSVQADDLAVYYCQNGYSYPFTFGSGTKLEIKGS
TSGSGKPGSGEGSTKGEVMLVESGGGLVKPGGSLKLSCAASGFTFSSYTVSWVRQTPEKRLEWVATSI
VGSTYTYFPDSVKGRFTISRDFAKNTLFLQMSSLRSEDTAMYYCSRLGRGNAMDYWGQGTSVSVSST
STTTPAPRPPTPAPTIASQPLSLRPEACRPAAGGAVHTRGLDFACDIYIWAPLAGTCGVLLLSLVITLYC
KRGRKKLLYIFKQPFMRPVQTTQEEDGCSCRFPEEEEGGCELRVKFSRSADAPAYQQGQNQLYNELN
LGRREEYDVLDKRRGRDPEMGGKPRRKNPQEGLYNELQKDKMAEAYSEIGMKGERRRGKGHDGLY
QGLSTATKDTYDALHMQALPPR C182036 amino acid sequence
SEQ ID NO: 334
MALPVTALLLPLALLLHAARPDIVMIQSPSSLTEKAGEKVSMSCKSSQSLLNSGNQKNYLTWYQQKP
GQPPKLLIYWASTRESGVPDRFTGSGSGTDFTLTISSVQAEDLAVYYCQNAYRFPFTFGDAGTKLELKG
STSGSGKPGSGEGSTKGQAYLQQSGAELVRSGASVKMSCKASGFTFSSHNIHWVKQTPGQGLEWIGY
IYPGNGDTNYNQKFKGKATLTADTSSSTAYMQISSLTSEDSAVYFCARDYYGNSFVYWGQGTLVTVS
ATSTTTPAPRPPTPAPTIASQPLSLRPEACRPAAGGAVHTRGLDFACDIYIWAPLAGTCGVLLLSLVITL
YCKRGRKKLLYIFKQPFMRPVQTTQEEDGCSCRFPEEEEGGCELRVKFSRSADAPAYQQGQNQLYNE
LNLGRREEYDVLDKRRGRDPEMGGKPRRKNPQEGLYNELQKDKMAEAYSEIGMKGERRRGKGHDG
LYQGLSTATKDTYDALHMQALPPR C182037 amino acid sequence
SEQ ID NO: 335
MALPVTALLLPLALLLHAARPDIVMTQSPSSLTEKAGERVSMSCKSSQSLFNSGNQKNYLTWYQQKP
GQPPKLLIYWASTRESGVPDRFTGSGSGTDFTLTISSVQAEDLAVYYCQNDYWYPFTFGAGTKLELKG
STSGSGKPGSGEGSTKGQAYLQQSGAELVRSGASVKMSCKASGYTFTSHNMHWVKQTPGQGLEWIG
YIYPGNGGTNYNQKFKGKATLTADTSSSTAYMQISSLTSEDSAVYFCTRDYYGNSFAYWGQGTLVTV
SATSTTTPAPRPPTPAPTIASQPLSLRPEACRPAAGGAVHTRGLDFACDIYIWAPLAGTCGVLLLSLVIT
LYCKRGRKKLLYIFKQPFMRPVQTTQEEDGCSCRFPEEEEGGCELRVKFSRSADAPAYQQGQNQLYN
ELNLGRREEYDVLDKRRGRDPEMGGKPRRKNPQEGLYNELQKDKMAEAYSEIGMKGERRRGKGHD
GLYQGLSTATKDTYDALHMQALPPR 175DX amino acid sequence
SEQ ID NO: 336
MALPVTALLLPLALLLHAARPDIVMTQSPSSLTVTAGEKVTMSCKSSQSLLNSGNQKNYLTWYQQKP
GQPPKLLIYWASTRESGVPDRFTGSGSGTDFTLTISSVQAEDLAVYYCQNDYSYPFTFGSGTKLEIKGS
TSGSGKPGSGEGSTKGQVQLQQPGAELVRPGASVKLSCKASGYTFTSYWINWVKQRPGQGLEWIGNI
YPSDSYTNYNQKFKDKATLTVDKSSSTAYMQLSSPTSEDSAVYYCTRSWRGNSFDYWGQGTTLTVSS
TSTTTPAPRPPTPAPTIASQPLSLRPEACRPAAGGAVHTRGLDFACDIYIWAPLAGTCGVLLLSLVITLY
CKRGRKKLLYIFKQPFMRPVQTTQEEDGCSCRFPEEEEGGCELRVKFSRSADAPAYQQGQNQLYNEL
NLGRREEYDVLDKRRGRDPEMGGKPRRKNPQEGLYNELQKDKMAEAYSEIGMKGERRRGKGHDGL
YQGLSTATKDTYDALHMQALPPR human IgG1 heavy chain domain
SEQ ID NO: 388
ASTKGPSVFPLAPSSKSTSGGTAALGCLVKDYFPEPVTVSWNSGALTSGVHTFPAVLQSSGLYSL
SSVVTVPSSSLGTQTYICNVNHKPSNTKVDKRVEPKSCDKTHTCPPCPAPELLGGPSVFLFPPKPK
DTLMISRTPEVTCVVVDVSHEDPEVKFNWYVDGVEVHNAKTKPREEQYNSTYRVVSVLTVLHQ
DWLNGKEYKCKVSNKALPAPIEKTISKAKGQPREPQVYTLPPSRDELTKNQVSLTCLVKGFYPSD
IAVEWESNGQPENNYKTTPPVLDSDGSFFLYSKLTVDKSRWQQGNVFSCSVMHEALHNHYTQK
SLSLSPGK light chain kappa constant region
SEQ ID NO: 389
RTVAAPSVFIFPPSDEQLKSGTASVVCLLNNFYPREAKVQWKVDNALQSGNSQESVTEQDSKDS
TYSLSSTLTLSKADYEKHKVYACEVTHQGLSSPVTKSFNRGEC

SEQUENCE LISTING (680 sequences)

SEQ ID NO: 1 - protein, 118 aa, Artificial Sequence
  260G9E8-VH
QADLQQSGAELVRSGASVKMSCKASGYTFASHNMHWVKQTPGQGLEWIGYIYPGNGGTKYNQKFTGKATLTADTSSSTAYMQITSLTSEDSAVYFCARDYYGNSFAYWGQGTLVTVSA

SEQ ID NO: 2 - protein, 113 aa, Artificial Sequence
  260G9E8-VL
DIVMTQSPSSLTEKAGEKVSMRCKSSQSLLNSGNQKNYLTWYQQKPGQPPKLLIYWASTRESGVPDRFTGSGSGTDFTLTISSVQADDLAVYYCQNDYMFPFTFGAGTKLELK

SEQ ID NO: 3 - protein, 118 aa, Artificial Sequence
  252F1B10-VH
QAYLQQSGAELVRSGASVKMSCKASGYTFTSHNMHWVKQTPGQGLEWIGYIYPGNGGTNYNQKFKGKATLTADTSSSTAYMQINSLTSEDSAVYFCTRDYYGNSFAYWGQGTLVTVSA

SEQ ID NO: 4 - protein, 113 aa, Artificial Sequence
  252F1B10-VL
DIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNDYRYPFTFGAGTKLELK

SEQ ID NO: 5 - protein, 118 aa, Artificial Sequence
  257B1G9-VH
QAYLQQSGAELVRSGASVKMSCKASGYTFTSHNMHWVKQTPGQGLEWIGYIYPGNGGTNYNQKFKGKATLTADTSSSTAYMQISSLTSEDSAVYFCTRDYYGNSFAYWGQGTLVTVSA

SEQ ID NO: 6 - protein, 113 aa, Artificial Sequence
  257B1G9-VL
DIVMTQSPSSLTERAGERVSMSCKSSQSLFNSGNQKNYLTWYQQKPGQPPKLLIYWASTRESGVPDRFTGSGSGTDFTLTISSVQAEDLAVYYCQNDYRYPFTFGAGTKLELK

SEQ ID NO: 7 - protein, 118 aa, Artificial Sequence
  265E6G2-VH
QAYLQQSGAELVRSGASVKMSCKASGYTFTSYNMHWVKQTPGQGLEWIGYIYPGNGGTNYNQKFKGKATLTADTSSSTAYMQISSLTSEDSAVYFCARDYYGNSFAYWGQGTLVTVSA

SEQ ID NO: 8 - protein, 113 aa, Artificial Sequence
  265E6G2-VL
DLVMTQSPSSLTVTAGEKVTMSCKSSQSLLNSGNQKNYLTWYQQKPGQPPKLLIYWASTRESGVPDRFTGSGSGTDFTLTISNIQAEDLAVYYCQNDYSYPLPFGAGTKLELR

SEQ ID NO: 9 - protein, 118 aa, Artificial Sequence
  250F4G4-VH
QAYLQQSGAELVRSGASVKMSCKASGYTFTSHNMHWVKQTPGQGLEWIGYIYPGNGRTNYNQKFKGKATLTADTSSSTAYMQISSLTSEDSAVYFCTRDYYGNSFAYWGQGTLVTVSA

SEQ ID NO: 10 - protein, 113 aa, Artificial Sequence
  250F4G4-VL
DIVMTQSPSSLTEKVGERVSMSCKSSQSLFNSGNQKNYLTWYQQKPGQPPKLLIYWASTRESGVPDRFTGSGSGTDFTLTISSVQAEDLAVYYCQNDYWYPFTFGAGTKLELK

SEQ ID NO: 11 - protein, 118 aa, Artificial Sequence
  262C7C10-VH
QAYLQQSGAELVRSGASVKMSCKASGYTFTNYNIHWVKQTPGQGLEWIGYIYPGNGGNYYNQKFKGKATLTADTSSITAYMQISSLTSEDSAVYFCARDYYGNSFAYWGQGTLVTVSA

SEQ ID NO: 12 - protein, 113 aa, Artificial Sequence
  262C7C10-VL
DIVMTQSPSSLTVTAGEKVTMNCKSSQSLLNSGNQKNYLTWYQQKPGQPPKLLIYWASTRESGVPDRFTGSGSGTDFTLTISSVQAEDLAIYYCQNDYYYPLTFGAGTKLELK

SEQ ID NO: 13 - protein, 118 aa, Artificial Sequence
  232C5E3-VH
QAYLQQSGAELVRSGASVKMSCKASGYTFTSHNIHWIKQTPGKGLEWIGYIYPGNGGTNYNQKFKAKATLTADTSSSTAYMQISSLTSEDSAVYFCARDYYGNSFAYWGQGTLVTVSA

SEQ ID NO: 14 - protein, 113 aa, Artificial Sequence
  232C5E3-VL
DIMMTQSPSSLTETAGEKVSMSCKSSQSLLNSGNQKNYLTWYQQKPGQPPKLLIYWASTRESGVPDRFSGSGSGTDFTLTISSVQAEDLAVYYCQNGYRFPFTFGAGTKLELK

SEQ ID NO: 15 - protein, 118 aa, Artificial Sequence
  252E7C9-VH
QTYLQQSGAELVRSGASVKMSCRTSGYSFTSHNMHWVKQTPGQGLEWIGYIYPGNGGSYYNQKFKGKAILTADTSSSTAYMQISSLTSEDSAVYFCTRDYYGNSFVYWGQGTLVTVSA

SEQ ID NO: 16 - protein, 113 aa, Artificial Sequence
  252E7C9-VL
DVVMTQSPSSLTEKTGEKVSMSCKSSQSLLNSGNQKNYLTWYQQKPGQPPKLLIYWASTRESGVPDRFTGSGSGTDFTLTISSLQTEDLAIYYCQNNFRYPFTFGAGTKLELK

SEQ ID NO: 17 - protein, 118 aa, Artificial Sequence
  257G7B9-VH
QAYLQQSGAELVRSGASVKMSCKASGYTFTSHNLHWVKQTPGQGLEWIGYIYPGNGNTNYNQKFKGKATLTADTSSSTAYMQISSLTSEDSAVYFCTRDYYGNSFAYWGQGTLVTVSA

SEQ ID NO: 18 - protein, 113 aa, Artificial Sequence
  257G7B9-VL
DIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNNYWFPFTFGAGTKLELK

SEQ ID NO: 19 - protein, 118 aa, Artificial Sequence
  241H10A1-VH
QVQLQQSGAELVKPGASVKLSCKASGYTFTSFGINWLRQRPEQGLEWIGWIFPGDGNSKYNENFKGKATLTTDKSSSTAYMQVTRLTSEDSAVYFCARFYYGNSFANWGQGTLVTVSA

SEQ ID NO: 20 - protein, 113 aa, Artificial Sequence
  241H10A1-VL
DIVMTQSPSSLTVTAGEKVTMSCKSSQSLLNSGNQKNYLTWYQQKPGQPPKLLIYWAATRESGVPDRFTGSGSGTDFTLTISSVQAEDLAVYYCQNDYFYPFTFGGGTKLELK

SEQ ID NO: 21 - protein, 118 aa, Artificial Sequence; identical to SEQ ID NO: 19
  273C10E5-VH

SEQ ID NO: 22 - protein, 113 aa, Artificial Sequence
  273C10E5-VL
DIVMTQSPSSLTVTAGEKVTMSCKSSQSLLNSGNQKNYLTWYQQKPGQPPKLLIYWAATRESGVPDRFAGSGSGTDFTLTISSVQAEDLAVYYCQNDYFYPFTFGAGTKLELK

SEQ ID NO: 23 - protein, 115 aa, Artificial Sequence
  185F2G12-VH
QAYLQQSGAELVRSGASVKMSCKASGYTFTSYNMHWVRQTPGQGLEWIGYIYPGNGGTNYSQKFKGKASLTADTSSTTAYMQISSLTSEDSAVYFCATGRGFAYWGQGTLVTVSA

SEQ ID NO: 24 - protein, 113 aa, Artificial Sequence
  185F2G12-VL
DIVMTQSPSSLTVTAGEKVTLSCKSSQSLFNTGNQKNYLTWYQQKPGQPPKLLIFRASTRESGVPDRFTGSGFGTDFTLTISSVQAEDLAVYYCQNDFSYPLTFGAGTKLELK

SEQ ID NO: 25 - protein, 115 aa, Artificial Sequence
  194D3B2-VH
QAYLQQSGAELVRSGASVKMSCKASGYPFTSYNMHWVKQTPGQGLEWVGYIYPGNGGTNYNQKFRDKATLTADTSSSTAYMQISRLTSDDSAVYFCLTGRGFAYWGQGTLVTVSA

SEQ ID NO: 26 - protein, 113 aa, Artificial Sequence
  194D3B2-VL
DIVMTQSPSSLIVTPGERVTMSCKSSQSLLNSGNQKNYLTWYQQKPGQPPKLLIYRASTRESGVPDRFTGSGSGTDFTLTISSVQAEDLAVYYCQNDYSYPLTFGIGTKLELK

SEQ ID NO: 27 - protein, 115 aa, Artificial Sequence
  207F8G5-VH
QAYLQQSGAELVRSGASVKMSCKASGFTFTSYNIHWVKQTPGQGLEWIGYISPGNGGSNYNLKFKDKATLTSATSSSTAYMQISSLTSEDSAVYFCATGRGFAYWGQGTLVTVSA

SEQ ID NO: 28 - protein, 113 aa, Artificial Sequence
  207F8G5-VL
DIVMTQSPSSLTVTPGEKVTMSCKSSQSLFNSGNQKNYLIWYQQKPGQPPKLLIYRASTRDSGVPDRFTGSGSGTDFTLTISNVQAEDLAIYYCQNDYSYPLTFGAGTKLELK

SEQ ID NO: 29 - protein, 115 aa, Artificial Sequence
  222B6G5-VH
QTYLQQSGAELVRSGASVKMSCKASGYTFTSYNIHWVKQTPGQGLEWIGYISPGNGGTYYNLKFKDKATLTTATSSSTAYMQISSLTSEDSAVYFCATGRGFAYWGQGTLVTVSA

SEQ ID NO: 30 - protein, 113 aa, Artificial Sequence
  222B6G5-VL
DIVMTQSPSSLTVTPGEKVTMSCKSSQSLFNSGNQKNYLIWYQQKPGQPPKLLIYRASTRDSGVPDRFTGSGSGTDFTLTISNVQAEDLAVYYCQNDYSYPLTFGAGTKLELK

SEQ ID NO: 31 - protein, 115 aa, Artificial Sequence
  182D10F1-VH
QAYLQQSGAELVRSGASVKMSCKASGYTFSSYNMHWVKQTPGQGLEWIGYIYPGNGGTNYNQKFKGKATLTADTSSSTAYMQISSLTSEDSAVYFCLTGRGFTYWGQGTLVTVSA

SEQ ID NO: 32 - protein, 113 aa, Artificial Sequence
  182D10F1-VL
DIVMTQSPSSLTVTAGEKVTMNCKSSQSLFNSGNQKNYLTWYQQKPGQPPKLLIYRASTRESGVPDRFTGSGSGTDFTLTISSVQAEDLAVYYCQNDYSYPLTFGVGTKLELK

SEQ ID NO: 33 - protein, 115 aa, Artificial Sequence
  234B9D4-VH
EIQLQQSGPDLMKPGSSVKISCTASGYSFTSYYIHWVKQSHGKTLEWIGYIDPFNGGTRYNQKFEGKAALTVDKSSTTAYMHLTSLTSDDSAVYYCASLRFFTYWGQGTLVTVSA

SEQ ID NO: 34 - protein, 113 aa, Artificial Sequence
  234B9D4-VL
DIVMTQSPSSLTVTAGEKVTMTCKSSQSLLNSGNQENYLTWYQQKPGQPPKLLISRASTRQSGVPDRFTGSGSGTDFTLTISSVQAEDLAVYYCQNDYSYPLTFGAGTKLELK

SEQ ID NO: 35 - protein, 115 aa, Artificial Sequence
  253E4F7-VH
EIQLQQSGPELMKPGASVKMSCKASGYSFTSYYIHWVKQSHGKSLEWIGYIDPFNGGTRYNQKFEGKATLTVDKSSTTAYMHLSSLTSEDSTVYYCASLRFLAYWGQGTLVTVSA

SEQ ID NO: 36 - protein, 113 aa, Artificial Sequence
  253E4F7-VL
DIVMTQSPSSLTVTAGEKVTMTCKSSQSLLNSGNQKNYLTWYQQKPGQPPKVLISRASTRQSGVPDRFTGSGSGTDFTLTISSVQAEDLAVYYCQNDYSYPLTFGAGTKLELK

SEQ ID NO: 37 - protein, 118 aa, Artificial Sequence
  370E2B12C3-VH
QVQLKESGPGLVAPSQSLSITCTVSGFSLTTYGVHWVRQPPGKGLEWLGVIWAGGSTNYNSALMSRVSINKDNSKSQVFIKMNSLQADDTALYYCARAAYYGNGLDYWGQGTTLTVSS

SEQ ID NO: 38 - protein, 113 aa, Artificial Sequence
  370E2B12C3-VL
DIVMTQSPSSLTVTAGEKVTMSCKSSQTLLNSGNQKNYLTWYQQKPGQPPKLLIYWASTGESGVPDRFTGSGSGTDFTLTISSVQAEDLAVYFCQNAYFYPFTFGGGTKLEIK

SEQ ID NO: 39 - protein, 117 aa, Artificial Sequence
  237D2A4-VH
QVQLKESGPGLVAPSQSLSITCTVSGFSLTSYGVSWVRQPPGKGLEWLGVIWGDGSTNYHSTLISRLRISKDKSKSQVFLKLNSLQTDDTATYYCAKAGRGNALDYWGQGTSVTVSS

SEQ ID NO: 40 - protein, 113 aa, Artificial Sequence
  237D2A4-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSFPLTFGAGTKLELK

SEQ ID NO: 41 - protein, 118 aa, Artificial Sequence
  203A6C9-VH
QVQLKQSGPGLVQPSQSLSITCTVSGFSLTRYGVHWVRQSPGKGLEWLGVIWSGGNTDYNAAFISRLNIRKDNSKSQVFFKMNSLKPNDTAIYYCARAAYFGNSFDYWGQGTTLTVSS

SEQ ID NO: 42 - protein, 113 aa, Artificial Sequence
  203A6C9-VL
DIVMTQSPSSLPVTAGEKVTMSCKSSQSLLNSGNQKNYLTWYQQKPGQPPKLLIYWASTRDSGVPDRFTGSGSGTDFTLTISSVQAEDLAVYYCQNNYIYPLTFGAGTKLELK

SEQ ID NO: 43 - protein, 117 aa, Artificial Sequence
  201F4H6-VH
QVQLKESGPGLVAPSQSLSITCTVSGFSLTSYGVSWVRQPPGKGLECLGVIWAGGNTNYNSALMSRLSISKDKSKSQVFLKMNSLQTDDTAMYYCARVYYGNAMDYWGQGTSVTVSS

SEQ ID NO: 44 - protein, 113 aa, Artificial Sequence
  201F4H6-VL
DIVMTQSPSSLTVTAGEKVTMSCKSSQSLLNSGNQKSYLTWYQQRPGQPPKLLIYWASTRESGVPDRFTGSGSGTDFTLTISSVQAEDLAVYFCQNVYFFPFTFGSGTKLETK

SEQ ID NO: 45 - protein, 118 aa, Artificial Sequence
  246B5F2-VH
EVMLVESGGGLMKPGGSLKLSCAASEFTFSNYAMSWVRQTPEKRLEWVATISSGRSSTYYPDSVKGRFTISRDNAKNTLYLQMSSLRSEDTAMYYCAGLGRGNAMEYWGQGTSVTVSS

SEQ ID NO: 46 - protein, 113 aa, Artificial Sequence
  246B5F2-VL
DIVMTQSPSSLTVTAGEKVTLSCKSSQSLLNSGNQKNYLTWYQQKPGQPPKLLIYWASTRESGVPDRFTGSGSGTDFILTINSVQAEDLAVYYCQNAYSYPFTFGSGTKLEIK

SEQ ID NO: 47 - protein, 118 aa, Artificial Sequence
  429H6C5-VH
DVQLVESGGGLVQPGGSRKLSCAASGFTFSSFGMHWVRQAPEKELEWVAYISSGSSTIYYAHTVKGRFTISRDNPKNTLFLRMTSLGSEDTAMYYCVRFYYGNSFVNWGQGTLVTVSA

SEQ ID NO: 48 - protein, 113 aa, Artificial Sequence
  429H6C5-VL
DIVMTQSPSSLTATAGEKVTMSCKSSQSLLNSGNQKNYLTWYQQKPGQPPKMLIYWASTRESGVPDRFAGSGSGTDFTLTISSVQAEDLAVYYCQNAYIYPLTFGAGTRLELK

SEQ ID NO: 49 - protein, 118 aa, Artificial Sequence
  407D8G1-VH
DVQLVESGGGLVQPGGSRKLSCAASGFTFSGFGMHWIRQTPEKGLEWVAYISSGSRPIYYADTVQGRFTISRDNPKNTLFLQMTSLRSEDTAMYFCARFYYGNSFDHWGQGTLVTVSS

SEQ ID NO: 50 - protein, 113 aa, Artificial Sequence
  407D8G1-VL
DIVMTQSPSFLTVTAGEKVTMSCKSSQSLLNSGNQKNYLTWYQQKPGQPPKLLIYWASTRESGVPDRFTGSGSGTDFTLTISSVQAEDLALYYCQNAYSFPLTFGAGTKLELK

SEQ ID NO: 51 - protein, 118 aa, Artificial Sequence
  419B5G9-VH
DVQLVESGGGLVQPGGSRKLSCAASGFTFSTFGMHWVRQAPEKGLEWVAYISGGSTTIFYADTVKGRFTISRDNPKNTLFLQMTSVRSEDTAMYYCARFYYGNSFAYWGPGTLVTVST

SEQ ID NO: 52 - protein, 113 aa, Artificial Sequence
  419B5G9-VL
DIVMTQSPSSLTVTAGEKVTMSCKSSQSLLNSGNQKNYLTWYQQKPGQPPKMLIYWASTRESGVPDRFTGSGSGTDFTLTISSVQAEDLAVYYCQNAYSYPLTFGAGTKLELK

SEQ ID NO: 53 - protein, 118 aa, Artificial Sequence
  393C2C5-VH
DVQLVESGGGLVQPGGSRKLSCAASGFTFSSFGMHWVRQAPEKGLEWVAYISSGSSPIYYADTVKGRFTISRDNPKNTLFLQMTSLRSEDTAMYFCATFYYGNSFAYWGQGTLVTVSA

SEQ ID NO: 54 - protein, 113 aa, Artificial Sequence
  393C2C5-VL
DIVMTQSPSSLTVTAGEKVTMSCKSSQTLLNSGNQKNYLTWYQQKSGQPPKLLIYWASTRESGVPDRFTGSGSGTDFTLTISSVQAEDLAVYYCQNAYSYPVTFGSGTKVELK

SEQ ID NO: 55 - protein, 118 aa, Artificial Sequence
  412B6E4-VH
DVQLVESGGGLVQPGGSRKLSCAASGFTFSSFGVHWVRQAPEKGLEWVAYISSGSSTIYYAHSVKGRFTISRDNPKNTLFLQMTSLGSEDTATYYCARFYYGNSFAYWGQGTLVTVSA

SEQ ID NO: 56 - protein, 113 aa, Artificial Sequence
  412B6E4-VL
DIVMTQSPSSLTVTAGEKVTMSCKSSQSLLNSGNQKNYLTWYQQKPGQPPKMLIYWASTRESGVPDRFTGSGSGTDFTLTISSVQAEDLAVYYCQNAYTYPLTFGAGTRLELK

SEQ ID NO: 57 - protein, 118 aa, Artificial Sequence
  414A5F7-VH
DVQLVESGGGLVQPGGSRKLSCAASGFTFSSFGMHWVRQAPEKGLEWVAYISSGSSPIYYADTVKGRFTISRDNPKNTLFLQMTSLRSEDTAMYFCARIYYGNSFAYWGQGTLVTVSA

SEQ ID NO: 58 - protein, 113 aa, Artificial Sequence
  414A5F7-VL
DIVMTQSPSSLTVTAGEKVAMSCKSSQTLLNSGNQKNYLTWYQQKPGQPPKLLLYWASTRESGVPDRFTGSGSGTDFTLTISSVQAEDLAVYYCQNAYYYPLTFGSGTKLELK

SEQ ID NO: 59 - protein, 118 aa, Artificial Sequence
  418D2F9-VH
DVQLVESGGGLVQPGGSRKLSCAASGFTFSSFGMHWVRQAPEKGLEWVAYINTGSSTIYYADTVKGRFTISRDNPKNTLFLQMTSLRSEDTAMYYCARIYYGNSFVYWGQGTLVTVSA

SEQ ID NO: 60 - protein, 113 aa, Artificial Sequence
  418D2F9-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 61 - protein, 118 aa, Artificial Sequence
  410H6H3-VH
DVLLVESGGGLVQPGGSRKLSCAASGFTFSSSGMHWVRQAPEKGLEWVAYISSGSNTIYYADTLKGRFTISRDNPKNTLFLQMTSLRSEDTAMYYCARIYYGNSFVYWGQGTLVTVSA

SEQ ID NO: 62 - protein, 113 aa, Artificial Sequence
  410H6H3-VL
DIVMTQSPSSLTVTAGEKVIMSCKSSQSLLNSGNQKNYLTWYQQKPGQPPKMLIYWASTRESGVPDRFRGSGSGTDFTLTISSVQAEDLAVYYCQNNYYYPLTFGTGTKLALK

SEQ ID NO: 63 - protein, 118 aa, Artificial Sequence
  418G6A5-VH
DVQLVESGGGLVQPGGSRKLSCVASGFTFSSFGMHWVRQAPEKGLEWVAYISSGSSPMYYADTVKGRFTISRDNPKNTLFLQMTSLRSEDTAMYFCARIYYGNSFAYWGQGTLVTVSA

SEQ ID NO: 64 - protein, 113 aa, Artificial Sequence
  418G6A5-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNAYSYPLTFGAGTKLELK

SEQ ID NO: 65 - protein, 112 aa, Artificial Sequence
  417A6F11-VH
EVQLQQSGPELVKPGASMKISCKASGYSFTGYTMNWVKQSHGKNLEWIGLINPYNGGTSYNQKFKGKATLTVDKSSSTAYMELLSLTSEDSAVYYCARGDYWGQGTTLTVSS

SEQ ID NO: 66 - protein, 112 aa, Artificial Sequence
  417A6F11-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPTFGAGTKLELK

SEQ ID NO: 67 - protein, 119 aa, Artificial Sequence
  59B6C4-VH
EVQLQQSGTVLARPGTSVKMSCKASGYRFTSSWMHWVKQRPGQGLEWIGANYPGKSDTTYTQKFKGKARLTAVTSASTAYMELSSLTNEDSAVYYCARGAYYGNAMDYWGQGTSVTVSS

SEQ ID NO: 68 - protein, 113 aa, Artificial Sequence
  59B6C4-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYSCQNAYSYPFTFGAGTKLELK

SEQ ID NO: 69 - protein, 5 aa, Artificial Sequence
  VH CDR1
SHNMH

SEQ ID NO: 70 - protein, 5 aa, Artificial Sequence
  VH CDR1
SYNMH

SEQ ID NO: 71 - protein, 5 aa, Artificial Sequence
  VH CDR1
NYNIH

SEQ ID NO: 72 - protein, 5 aa, Artificial Sequence
  VH CDR1
SHNIH

SEQ ID NO: 73 - protein, 5 aa, Artificial Sequence
  VH CDR1
SHNLH

SEQ ID NO: 74 - protein, 5 aa, Artificial Sequence
  VH CDR1
SFGIN

SEQ ID NO: 75 - protein, 5 aa, Artificial Sequence
  VH CDR1
SYNIH

SEQ ID NO: 76 - protein, 5 aa, Artificial Sequence
  VH CDR1
SYYIH

SEQ ID NO: 77 - protein, 5 aa, Artificial Sequence
  VH CDR1
TYGVH

SEQ ID NO: 78 - protein, 5 aa, Artificial Sequence
  VH CDR1
SYGVS

SEQ ID NO: 79 - protein, 5 aa, Artificial Sequence
  VH CDR1
RYGVH

SEQ ID NO: 80 - protein, 5 aa, Artificial Sequence
  VH CDR1
SFGMH

SEQ ID NO: 81 - protein, 5 aa, Artificial Sequence
  VH CDR1
GFGMH

SEQ ID NO: 82 - protein, 5 aa, Artificial Sequence
  VH CDR1
TFGMH

SEQ ID NO: 83 - protein, 5 aa, Artificial Sequence
  VH CDR1
SFGVH

SEQ ID NO: 84 - protein, 5 aa, Artificial Sequence
  VH CDR1
SSGMH

SEQ ID NO: 85 - protein, 5 aa, Artificial Sequence
  VH CDR1
SSWMH

SEQ ID NO: 86 - protein, 5 aa, Artificial Sequence
  VH CDR1
NYAMS

SEQ ID NO: 87 - protein, 5 aa, Artificial Sequence
  VH CDR1
SFGMH

SEQ ID NO: 88 - protein, 11 aa, Artificial Sequence
  VH CDR1
SGYSFTGYTMN

SEQ ID NO: 89 - protein, 17 aa, Artificial Sequence
  VH CDR2
YIYPGNGGTKYNQKFTG

SEQ ID NO: 90 - protein, 17 aa, Artificial Sequence
  VH CDR2
YIYPGNGGTNYNQKFKG

SEQ ID NO: 91 - protein, 17 aa, Artificial Sequence
  VH CDR2
YIYPGNGRTNYNQKFKG

SEQ ID NO: 92 - protein, 17 aa, Artificial Sequence
  VH CDR2
YIYPGNGGNYYNQKFKG

SEQ ID NO: 93 - protein, 17 aa, Artificial Sequence
  VH CDR2
YIYPGNGGTNYNQKFKA

SEQ ID NO: 94 - protein, 17 aa, Artificial Sequence
  VH CDR2
YIYPGNGGSYYNQKFKG

SEQ ID NO: 95 - protein, 17 aa, Artificial Sequence
  VH CDR2
YIYPGNGNTNYNQKFKG

SEQ ID NO: 96 - protein, 17 aa, Artificial Sequence
  VH CDR2
WIFPGDGNSKYNENFKG

SEQ ID NO: 97 - protein, 17 aa, Artificial Sequence
  VH CDR2
YIYPGNGGTNYSQKFKG

SEQ ID NO: 98 - protein, 17 aa, Artificial Sequence
  VH CDR2
YIYPGNGGTNYNQKFRD

SEQ ID NO: 99 - protein, 17 aa, Artificial Sequence
  VH CDR2
YISPGNGGSNYNLKFKD

SEQ ID NO: 100 - protein, 17 aa, Artificial Sequence
  VH CDR2
YISPGNGGTYYNLKFKD

SEQ ID NO: 101 - protein, 17 aa, Artificial Sequence
  VH CDR2
YIDPFNGGTRYNQKFEG

SEQ ID NO: 102 - protein, 16 aa, Artificial Sequence
  VH CDR2
VIWAGGSTNYNSALMS

SEQ ID NO: 103 - protein, 16 aa, Artificial Sequence
  VH CDR2
VIWGDGSTNYHSTLIS

SEQ ID NO: 104 - protein, 16 aa, Artificial Sequence
  VH CDR2
VIWSGGNTDYNAAFIS

SEQ ID NO: 105 - protein, 16 aa, Artificial Sequence
  VH CDR2
VIWAGGNTNYNSALMS

SEQ ID NO: 106 - protein, 17 aa, Artificial Sequence
  VH CDR2
YISSGSSTIYYAHTVKG

SEQ ID NO: 107 - protein, 17 aa, Artificial Sequence
  VH CDR2
YISSGSRPIYYADTVQG

SEQ ID NO: 108 - protein, 17 aa, Artificial Sequence
  VH CDR2
YISGGSTTIFYADTVKG

SEQ ID NO: 109 - protein, 17 aa, Artificial Sequence
  VH CDR2
YISSGSSPIYYADTVKG

SEQ ID NO: 110 - protein, 17 aa, Artificial Sequence
  VH CDR2
YISSGSSTIYYAHSVKG

SEQ ID NO: 111 - protein, 17 aa, Artificial Sequence
  VH CDR2
YINTGSSTIYYADTVKG

SEQ ID NO: 112 - protein, 17 aa, Artificial Sequence
  VH CDR2
YISSGSNTIYYADTLKG

SEQ ID NO: 113 - protein, 17 aa, Artificial Sequence
  VH CDR2
ANYPGKSDTTYTQKFKG

SEQ ID NO: 114 - protein, 17 aa, Artificial Sequence
  VH CDR2
TISSGRSSTYYPDSVKG

SEQ ID NO: 115 - protein, 17 aa, Artificial Sequence
  VH CDR2
YISSGSSPMYYADTVKG

SEQ ID NO: 116 - protein, 17 aa, Artificial Sequence
  VH CDR2
LINPYNGGTSYNQKFKG

SEQ ID NO: 117 - protein, 9 aa, Artificial Sequence
  VH CDR3
DYYGNSFAY

SEQ ID NO: 118 - protein, 9 aa, Artificial Sequence
  VH CDR3
DYYGNSFVY

SEQ ID NO: 119 - protein, 9 aa, Artificial Sequence
  VH CDR3
FYYGNSFAN

SEQ ID NO: 120 - protein, 6 aa, Artificial Sequence
  VH CDR3
GRGFAY

SEQ ID NO: 121 - protein, 6 aa, Artificial Sequence
  VH CDR3
GRGFTY

SEQ ID NO: 122 - protein, 6 aa, Artificial Sequence
  VH CDR3
LRFFTY

SEQ ID NO: 123 - protein, 6 aa, Artificial Sequence
  VH CDR3
LRFLAY

SEQ ID NO: 124 - protein, 10 aa, Artificial Sequence
  VH CDR3
AAYYGNGLDY

SEQ ID NO: 125 - protein, 9 aa, Artificial Sequence
  VH CDR3
AGRGNALDY

SEQ ID NO: 126 - protein, 10 aa, Artificial Sequence
  VH CDR3
AAYFGNSFDY

SEQ ID NO: 127 - protein, 9 aa, Artificial Sequence
  VH CDR3
VYYGNAMDY

SEQ ID NO: 128 - protein, 9 aa, Artificial Sequence
  VH CDR3
FYYGNSFVN

SEQ ID NO: 129 - protein, 9 aa, Artificial Sequence
  VH CDR3
FYYGNSFDH

SEQ ID NO: 130 - protein, 9 aa, Artificial Sequence
  VH CDR3
FYYGNSFAY

SEQ ID NO: 131 - protein, 9 aa, Artificial Sequence
  VH CDR3
IYYGNSFAY

SEQ ID NO: 132 - protein, 9 aa, Artificial Sequence
  VH CDR3
IYYGNSFVY

SEQ ID NO: 133 - protein, 10 aa, Artificial Sequence
  VH CDR3
GAYYGNAMDY

SEQ ID NO: 134 - protein, 9 aa, Artificial Sequence
  VH CDR3
LGRGNAMEY

SEQ ID NO: 135 - protein, 3 aa, Artificial Sequence
  VH CDR3
GDY

SEQ ID NO: 136 - protein, 17 aa, Artificial Sequence
  VL CDR1
KSSQSLLNSGNQKNYLT

SEQ ID NO: 137 - protein, 17 aa, Artificial Sequence
  VL CDR1
KSSQSLFNSGNQKNYLT

SEQ ID NO: 138 - protein, 17 aa, Artificial Sequence
  VL CDR1
KSSQSLFNTGNQKNYLT

SEQ ID NO: 139 - protein, 17 aa, Artificial Sequence
  VL CDR1
KSSQSLFNSGNQKNYLI

SEQ ID NO: 140 - protein, 17 aa, Artificial Sequence
  VL CDR1
KSSQSLLNSGNQENYLT

SEQ ID NO: 141 - protein, 17 aa, Artificial Sequence
  VL CDR1
KSSQTLLNSGNQKNYLT

SEQ ID NO: 142 - protein, 17 aa, Artificial Sequence
  VL CDR1
KSSQSLLNSGNQKSYLT

SEQ ID NO: 143 - protein, 7 aa, Artificial Sequence
  VL CDR2
WASTRES

SEQ ID NO: 144 - protein, 7 aa, Artificial Sequence
  VL CDR2
WAATRES

SEQ ID NO: 145 - protein, 7 aa, Artificial Sequence
  VL CDR2
RASTRES

SEQ ID NO: 146 - protein, 7 aa, Artificial Sequence
  VL CDR2
RASTRDS

SEQ ID NO: 147 - protein, 7 aa, Artificial Sequence
  VL CDR2
RASTRQS

SEQ ID NO: 148 - protein, 7 aa, Artificial Sequence
  VL CDR2
WASTGES

SEQ ID NO: 149 - protein, 7 aa, Artificial Sequence
  VL CDR2
WASTRDS

SEQ ID NO: 150 - protein, 9 aa, Artificial Sequence
  VL CDR3
QNDYMFPFT

SEQ ID NO: 151 - protein, 9 aa, Artificial Sequence
  VL CDR3
QNDYRYPFT

SEQ ID NO: 152 - protein, 9 aa, Artificial Sequence
  VL CDR3
QNDYSYPLP

SEQ ID NO: 153 - protein, 9 aa, Artificial Sequence
  VL CDR3
QNDYWYPFT

SEQ ID NO: 154 - protein, 9 aa, Artificial Sequence
  VL CDR3
QNDYYYPLT

SEQ ID NO: 155 - protein, 9 aa, Artificial Sequence
  VL CDR3
QNGYRFPFT

SEQ ID NO: 156 - protein, 9 aa, Artificial Sequence
  VL CDR3
QNNFRYPFT

SEQ ID NO: 157 - protein, 9 aa, Artificial Sequence
  VL CDR3
QNNYWFPFT

SEQ ID NO: 158 - protein, 9 aa, Artificial Sequence
  VL CDR3
QNDYFYPFT

SEQ ID NO: 159 - protein, 9 aa, Artificial Sequence
  VL CDR3
QNDFSYPLT

SEQ ID NO: 160 - protein, 9 aa, Artificial Sequence
  VL CDR3
QNDYSYPLT

SEQ ID NO: 161 - protein, 9 aa, Artificial Sequence
  VL CDR3
QNAYFYPFT

SEQ ID NO: 162 - protein, 9 aa, Artificial Sequence
  VL CDR3
QNDYSFPLT

SEQ ID NO: 163 - protein, 9 aa, Artificial Sequence
  VL CDR3
QNNYIYPLT

SEQ ID NO: 164 - protein, 9 aa, Artificial Sequence
  VL CDR3
QNVYFFPFT

SEQ ID NO: 165 - protein, 9 aa, Artificial Sequence
  VL CDR3
QNAYIYPLT

SEQ ID NO: 166 - protein, 9 aa, Artificial Sequence
  VL CDR3
QNAYSFPLT

SEQ ID NO: 167 - protein, 9 aa, Artificial Sequence
  VL CDR3
QNAYSYPLT

SEQ ID NO: 168 - protein, 9 aa, Artificial Sequence
  VL CDR3
QNAYSYPVT

SEQ ID NO: 169 - protein, 9 aa, Artificial Sequence
  VL CDR3
QNAYTYPLT

SEQ ID NO: 170 - protein, 9 aa, Artificial Sequence
  VL CDR3
QNAYYYPLT

SEQ ID NO: 171 - protein, 9 aa, Artificial Sequence
  VL CDR3
QNNYYYPLT

SEQ ID NO: 172 - protein, 9 aa, Artificial Sequence
  VL CDR3
QNAYSYPFT

SEQ ID NO: 173 - protein, 8 aa, Artificial Sequence
  VL CDR3
QNDYSYPT

SEQ ID NO: 174 - protein, 5 aa, Artificial Sequence
  VH CDR1
  VARIANT (1)..(1): Xaa can be S or N
  VARIANT (2)..(2): Xaa can be H, Y or F
  VARIANT (3)..(3): Xaa can be N or G
  VARIANT (4)..(4): Xaa can be M, I or L
  VARIANT (5)..(5): Xaa can be H or N
XXXXX

SEQ ID NO: 175 - protein, 17 aa, Artificial Sequence
  VH CDR2
  VARIANT (1)..(1): Xaa can be Y or W
  VARIANT (3)..(3): Xaa can be Y or F
  VARIANT (6)..(6): Xaa can be N or D
  VARIANT (8)..(8): Xaa can be G,R or N
  VARIANT (9)..(9): Xaa can be T, N or S
  VARIANT (10)..(10): Xaa can be K, N or Y
  VARIANT (13)..(13): Xaa can be Q or E
  VARIANT (14)..(14): Xaa can be K or N
  VARIANT (16)..(16): Xaa can be T or K
  VARIANT (17)..(17): Xaa can be G or A
XIXPGXGXXXYNXXFXX

SEQ ID NO: 176 - protein, 9 aa, Artificial Sequence
  VH CDR3
  VARIANT (1)..(1): Xaa can be D or F
  VARIANT (8)..(8): Xaa can be A or V
  VARIANT (9)..(9): Xaa can be Y or N
XYYGNSFXX

SEQ ID NO: 177 - protein, 5 aa, Artificial Sequence
  VH CDR1
  VARIANT (3)..(3): Xaa can be N or Y
  VARIANT (4)..(4): Xaa can be M or I
SYXXH

SEQ ID NO: 178 - protein, 17 aa, Artificial Sequence
  VH CDR2
  VARIANT (3)..(3): Xaa can be Y, S, or D
  VARIANT (5)..(5): Xaa can be G or F
  VARIANT (9)..(9): Xaa can be T or S
  VARIANT (10)..(10): Xaa can be N, Y or R
  VARIANT (12)..(12): Xaa can be S or N
  VARIANT (13)..(13): Xaa can be Q or L
  VARIANT (16)..(16): Xaa can be K,R or E
  VARIANT (17)..(17): Xaa can be G or D
YIXPXNGGXXYXXKFXX

SEQ ID NO: 179 - protein, 6 aa, Artificial Sequence
  VH CDR3
  VARIANT (1)..(1): Xaa can be G or L
  VARIANT (3)..(3): Xaa can be G or F
  VARIANT (4)..(4): Xaa can be F or L
  VARIANT (5)..(5): Xaa can be A or T
XRXXXY

SEQ ID NO: 180 - protein, 5 aa, Artificial Sequence
  VH CDR1
  VARIANT (1)..(1): Xaa can be T,S or R
  VARIANT (5)..(5): Xaa can be H or S
XYGVX

SEQ ID NO: 181 - protein, 16 aa, Artificial Sequence
  VH CDR2
  VARIANT (4)..(4): Xaa can be A, G or S
  VARIANT (5)..(5): Xaa can be G or D
  VARIANT (7)..(7): Xaa can be S or N
  VARIANT (9)..(9): Xaa can be N or D
  VARIANT (11)..(11): Xaa can be N or H
  VARIANT (12)..(12): Xaa can be S or A
  VARIANT (13)..(13): Xaa can be A or T
  VARIANT (14)..(14): Xaa can be L or F
  VARIANT (15)..(15): Xaa can be M or I
VIWXXGXTXYXXXXXS

SEQ ID NO: 182 - protein, 10 aa, Artificial Sequence
  VH CDR3
  VARIANT (1)..(1): Xaa can be A or null
  VARIANT (2)..(2): Xaa can be A, G or V
  VARIANT (3)..(3): Xaa can be Y or R
  VARIANT (4)..(4): Xaa can be Y,F or null
  VARIANT (7)..(7): Xaa can be A,G or S
  VARIANT (8)..(8): Xaa can be L,F or M
XXXXGNXXDY

SEQ ID NO: 183 - protein, 5 aa, Artificial Sequence
  VH CDR1
  VARIANT (1)..(1): Xaa can be S,G or T
  VARIANT (2)..(2): Xaa can be F or S
XXGMH

SEQ ID NO: 184 - protein, 17 aa, Artificial Sequence
  VH CDR2
  VARIANT (3)..(3): Xaa can be S or N
  VARIANT (4)..(4): Xaa can be S, G or T
  VARIANT (7)..(7): Xaa can be S, R,T or N
  VARIANT (8)..(8): Xaa can be T or P
  VARIANT (10)..(10): Xaa can be Y or F
  VARIANT (13)..(13): Xaa can be D or H
  VARIANT (14)..(14): Xaa can be T or S
  VARIANT (15)..(15): Xaa can be V or L
  VARIANT (16)..(16): Xaa can be K or Q
YIXXGSXXIXYAXXXXG

SEQ ID NO: 185 - protein, 9 aa, Artificial Sequence
  VH CDR3
  VARIANT (1)..(1): Xaa can be F or I
  VARIANT (8)..(8): Xaa can be V, D or A
  VARIANT (9)..(9): Xaa can be Y, N or H
XYYGNSFXX

SEQ ID NO: 186 - protein, 17 aa, Artificial Sequence
  VL CDR1
  VARIANT (7)..(7): Xaa can be L or F
KSSQSLXNSGNQKNYLT

SEQ ID NO: 187 - protein, 7 aa, Artificial Sequence
  VL CDR2
  VARIANT (3)..(3): Xaa can be S or A
WAXTRES

SEQ ID NO: 188 - protein, 9 aa, Artificial Sequence
  VL CDR3
  VARIANT (3)..(3): Xaa can be D,G or N
  VARIANT (4)..(4): Xaa can be Y or F
  VARIANT (5)..(5): Xaa can be M,R,S,W,Y or F
  VARIANT (6)..(6): Xaa can be F or Y
  VARIANT (8)..(8): Xaa can be F or L
  VARIANT (9)..(9): Xaa can be T or P
QNXXXXPXX

SEQ ID NO: 189 - protein, 17 aa, Artificial Sequence
  VL CDR1
  VARIANT (7)..(7): Xaa can be F or L
  VARIANT (9)..(9): Xaa can be T or S
  VARIANT (13)..(13): Xaa can be K or E
  VARIANT (17)..(17): Xaa can be T or I
KSSQSLXNXGNQXNYLX

SEQ ID NO: 190 - protein, 7 aa, Artificial Sequence
  VL CDR2
  VARIANT (6)..(6): Xaa can be E,D or Q
RASTRXS

SEQ ID NO: 191 - protein, 9 aa, Artificial Sequence
  VL CDR3
  VARIANT (4)..(4): Xaa can be F or Y
QNDXSYPLT

SEQ ID NO: 192 - protein, 17 aa, Artificial Sequence
  VL CDR1
  VARIANT (5)..(5): Xaa can be T or S
  VARIANT (14)..(14): Xaa can be N or S
KSSQXLLNSGNQKXYLT

SEQ ID NO: 193 - protein, 7 aa, Artificial Sequence
  VL CDR2
  VARIANT (5)..(5): Xaa can be G or R
  VARIANT (6)..(6): Xaa can be E or D
WASTXXS

SEQ ID NO: 194 - protein, 9 aa, Artificial Sequence
  VL CDR3
  VARIANT (3)..(3): Xaa can be A,D,N or V
  VARIANT (5)..(5): Xaa can be F,S or I
  VARIANT (6)..(6): Xaa can be Y or F
  VARIANT (8)..(8): Xaa can be F or L
QNXYXXPXT

SEQ ID NO: 195 - protein, 17 aa, Artificial Sequence
  VL CDR1
  VARIANT (5)..(5): Xaa can be S or T
KSSQXLLNSGNQKNYLT

SEQ ID NO: 196 - protein, 9 aa, Artificial Sequence
  VL CDR3
  VARIANT (3)..(3): Xaa can be A,D or N
  VARIANT (5)..(5): Xaa can be I,S,T or Y
  VARIANT (6)..(6): Xaa can be F or Y
  VARIANT (8)..(8): Xaa can be L or V
QNXYXXPXT

SEQ ID NO: 197 - protein, 16 aa, Artificial Sequence
  VH CDR2
VIWAGGSTNYHSALMS

SEQ ID NO: 198 - protein, 10 aa, Artificial Sequence
  VH CDR2
AAYYGNALDY

SEQ ID NO: 199 - protein, 17 aa, Artificial Sequence
  VH CDR2
YISSGSSTIYYADTVKG

SEQ ID NO: 200 - protein, 261 aa, Artificial Sequence
  The human Claudin18.2 protein
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 201 - protein, 17 aa, Artificial Sequence
  VH CDR2
YIYPGNGGTNYNQKFKD

SEQ ID NO: 202 - protein, 17 aa, Artificial Sequence
  VH CDR2
YIYPGNGGTYYNQKFKG

SEQ ID NO: 203 - protein, 5 aa, Artificial Sequence
  VH CDR1
SYWIE

SEQ ID NO: 204 - protein, 5 aa, Artificial Sequence
  VH CDR1
TAGMQ

SEQ ID NO: 205 - protein, 5 aa, Artificial Sequence
  VH CDR1
DYGVS

SEQ ID NO: 206 - protein, 5 aa, Artificial Sequence
  VH CDR1
DYGMA

SEQ ID NO: 207 - protein, 5 aa, Artificial Sequence
  VH CDR1
YYGVH

SEQ ID NO: 208 - protein, 5 aa, Artificial Sequence
  VH CDR1
DYSMH

SEQ ID NO: 209 - protein, 5 aa, Artificial Sequence
  VH CDR1
TYGVS

SEQ ID NO: 210 - protein, 5 aa, Artificial Sequence
  VH CDR1
SYTVS

SEQ ID NO: 211 - protein, 17 aa, Artificial Sequence
  VH CDR2
EILPGSGSTNYNEKFKG

SEQ ID NO: 212 - protein, 17 aa, Artificial Sequence
  VH CDR2
WINTHSRVPNFAEDFKG

SEQ ID NO: 213 - protein, 16 aa, Artificial Sequence
  VH CDR2
VIWGGGSTYYNSALKS

SEQ ID NO: 214 - protein, 17 aa, Artificial Sequence
  VH CDR2
FISNLAYSIYYADTVTG

SEQ ID NO: 215 - protein, 16 aa, Artificial Sequence
  VH CDR2
VIWRGGNTDYNAAFIS

SEQ ID NO: 216 - protein, 17 aa, Artificial Sequence
  VH CDR2
WINSETGEATYADDFRG

SEQ ID NO: 217 - protein, 17 aa, Artificial Sequence
  VH CDR2
YIYPGNGDTNYNQKFKG

SEQ ID NO: 218 - protein, 16 aa, Artificial Sequence
  VH CDR2
VIWGDGSTHYHSALIS

SEQ ID NO: 219 - protein, 17 aa, Artificial Sequence
  VH CDR2
YISPGNGYTNYNQKFRG

SEQ ID NO: 220 - protein, 17 aa, Artificial Sequence
  VH CDR2
YIYPGSGGSNYNQKFMG

SEQ ID NO: 221 - protein, 17 aa, Artificial Sequence
  VH CDR2
YIYPGNSGTKYNQKFTG

SEQ ID NO: 222 - protein, 17 aa, Artificial Sequence
  VH CDR2
YIYPGNGAPNYNQKFRG

SEQ ID NO: 223 - protein, 17 aa, Artificial Sequence
  VH CDR2
YIYPGNGNTYYNQKFKV

SEQ ID NO: 224 - protein, 17 aa, Artificial Sequence
  VH CDR2
TSIVGSTYTYFPDSVKG

SEQ ID NO: 225 - protein, 10 aa, Artificial Sequence
  VH CDR3
YGGLRRYFDY

SEQ ID NO: 226 - protein, 9 aa, Artificial Sequence
  VH CDR3
LGKGNTMDF

SEQ ID NO: 227 - protein, 9 aa, Artificial Sequence
  VH CDR3
HHYGNACDY

SEQ ID NO: 228 - protein, 10 aa, Artificial Sequence
  VH CDR3
AAYYGNCFDY

SEQ ID NO: 229 - protein, 9 aa, Artificial Sequence
  VH CDR3
FYYGNSFAS

SEQ ID NO: 230 - protein, 9 aa, Artificial Sequence
  VH CDR3
DYFGNSFAY

SEQ ID NO: 231 - protein, 9 aa, Artificial Sequence
  VH CDR3
PGRGNAMDY

SEQ ID NO: 232 - protein, 9 aa, Artificial Sequence
  VH CDR3
LGRGNAMDY

SEQ ID NO: 233 - protein, 11 aa, Artificial Sequence
  VL CDR1
KASQDVSTAVA

SEQ ID NO: 234 - protein, 17 aa, Artificial Sequence
  VL CDR1
KSSQSLFNSGNLKNYLT

SEQ ID NO: 235 - protein, 17 aa, Artificial Sequence
  VL CDR1
KSSQSLLNSGNLRNYLT

SEQ ID NO: 236 - protein, 17 aa, Artificial Sequence
  VL CDR1
KSSQSLLNGGNQKNYLT

SEQ ID NO: 237 - protein, 17 aa, Artificial Sequence
  VL CDR1
KSSQSLFNSGNQRNYLT

SEQ ID NO: 238 - protein, 17 aa, Artificial Sequence
  VL CDR1
KSSQSLFNSGSQKNYLT

SEQ ID NO: 239 - protein, 17 aa, Artificial Sequence
  VL CDR1
KSSQSLLNSGNQKNYLA

SEQ ID NO: 240 - protein, 17 aa, Artificial Sequence
  VL CDR1
RSSQSLLNSGNQKNYLT

SEQ ID NO: 241 - protein, 7 aa, Artificial Sequence
  VL CDR2
SASYRYT

SEQ ID NO: 242 - protein, 9 aa, Artificial Sequence
  VL CDR3
QQHYSTPRT

SEQ ID NO: 243 - protein, 9 aa, Artificial Sequence
  VL CDR3
QNSYSFPLT

SEQ ID NO: 244 - protein, 9 aa, Artificial Sequence
  VL CDR3
QNDYSYPFT

SEQ ID NO: 245 - protein, 9 aa, Artificial Sequence
  VL CDR3
QNGYSYPFT

SEQ ID NO: 246 - protein, 9 aa, Artificial Sequence
  VL CDR3
QNNYYFPLT

SEQ ID NO: 247 - protein, 9 aa, Artificial Sequence
  VL CDR3
QNAYWYPFT

SEQ ID NO: 248 - protein, 9 aa, Artificial Sequence
  VL CDR3
QNDYIYPLT

SEQ ID NO: 249 - protein, 9 aa, Artificial Sequence
  VL CDR3
QNNYMYPFT

SEQ ID NO: 250 - protein, 9 aa, Artificial Sequence
  VL CDR3
QNAYRFPFT

SEQ ID NO: 251 - protein, 119 aa, Artificial Sequence
  28C5B1-VH
QVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYGGLRRYFDYWGQGTTLTVSS

SEQ ID NO: 252 - protein, 107 aa, Artificial Sequence
  28C5B1-VL
DIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPRTFGGGTKLEIK

SEQ ID NO: 253 - protein, 118 aa, Artificial Sequence
  35E8D2-VH
QIQLVQSGPELKKPGETVRISCKASGYTFTTAGMQWVQKMPGKGLKWIGWINTHSRVPNFAEDFKGRFAFSLETSARIAYLQISNIKNEDMATYFCARLGKGNTMDFWGQGTSVTVSS

SEQ ID NO: 254 - protein, 113 aa, Artificial Sequence
  35E8D2-VL
DIVMTQSPSSLTVTVGEKVTMSCKSSQSLLNSGNQKNYLTWYQQKPGQPPKLLIYWASTRESGVPDRFTGSGSETDFTLTISSLQAEDLAVYYCQNSYSFPLTFGGGTNLEIK

SEQ ID NO: 255 - protein, 117 aa, Artificial Sequence
  61H12G10-VH
QVQLKESGPGLVAPSQSLSITCTVSGFSLTDYGVSWIRQPPGKGLEWLGVIWGGGSTYYNSALKSRLIISKDNSKSQVFLKMNSLQTDDTAIYYCAKHHYGNACDYWGQGTTLTVSS

SEQ ID NO: 256 - protein, 113 aa, Artificial Sequence
  61H12G10-VL
DIVMTQSPSSLTVTAGEKVTMSCKSSQSLFNSGNLKNYLTWYQQKPGQPPKLLICWASTRESGVPDRFTGSGSGTEFTLTISSVQAEDLAVYYCQNDYSYPFTFGSGTKLEIK

SEQ ID NO: 257 - protein, 116 aa, Artificial Sequence
  69D5C1-VH
EVKLVESGGGLVQPGGSRKLSCAASGFTFRDYGMAWVRQAPGKGPEWITFISNLAYSIYYADTVTGRFTISTENAKNTLYLEMSSLRSEDTAMYYCAVIYYGNSFAYWGQGTLVTV

SEQ ID NO: 258 - protein, 113 aa, Artificial Sequence
  69D5C1-VL
DIVLTQSPSSLTVTAGEKVTMSCKSSQSLLNSGNLRNYLTWYQQKPGQPPKLLIYWASTRESGVPDRFTGSGSGTDFTLTISSLQAEDLAIYYCQNGYSYPFTFGSGTKLEIK

SEQ ID NO: 259 - protein, 118 aa, Artificial Sequence
  181C7B2-VH
QVQLKQSGPGLVQPSQSLSITCTVSGFSLTYYGVHWVRQSPGKGLEWLGVIWRGGNTDYNAAFISRLSINKDNSKSQVFFKMNSLQPNDTAIYYCARAAYYGNCFDYWGQGTTLTVSS

SEQ ID NO: 260 - protein, 113 aa, Artificial Sequence
  181C7B2-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNNYIYPLTFGAGTKLELK

SEQ ID NO: 261 - protein, 118 aa, Artificial Sequence
  196A12B10-VH
QIQWVQSGPELKKPRETVKISCKASGYTFTDYSMHWVKQAPGKGLKWMGWINSETGEATYADDFRGRFALSLETSATTAFLQINSLKNEDTGTYFCARFYYGNSFASWGQGTTLTVSS

SEQ ID NO: 262 - protein, 113 aa, Artificial Sequence
  196A12B10-VL
DIVMTQFPSSLTVTAGEKVTMTCKSSQSLLNGGNQKNYLTWYQQKPGLPPKLLIYWASTRESGVPDRFTGSGSGTEFTLTISSVQAEDLAVYYCQNNYYFPLTFGAGTKLELK

SEQ ID NO: 263 - protein, 115 aa, Artificial Sequence
  198F10B8-VH
QAYLQQSGAELVRSGASVRMSCKASGYTFSSYNMHWVKQTPGQGLEWIGYIYPGNGGTNYNQKFKDKATLTADTSSSTAFIQISSLTSEDSAVYFCLTGRGFAYWGQGTLVTVSA

SEQ ID NO: 264 - protein, 113 aa, Artificial Sequence
  198F10B8-VL
DIVMTQSPSSLTVTAGERVTMSCKSSQSLFNSGNQKNYLTWYQQKPGQPPKLLIYRASTRESGVPDRFTGSGSGTDFTLTISSVQAEDLAVYYCQNDYSYPLTFGVGTKLELK

SEQ ID NO: 265 - protein, 115 aa, Artificial Sequence
  213B10A4-VH
QAYVQQSGAELVRSGASVKMSCRASGYTFTSYNMHWVKQTPGQGLEWIGYIYPGNGGTYYNQKFKGKATLTADTSSSTAYMQISSLTSEDSAVYFCATGRGFAYWGQGTLVTVSA

SEQ ID NO: 266 - protein, 113 aa, Artificial Sequence
  213B10A4-VL
DIVMTQSPSSLTVTAGEKVTMSCKSSQSLLNSGNQKNYLTWYQQKPGQPPKLLIYRASTRESGVPDRFTGSGFGTDFTLTISSVQAEDLAVYYCQNDYSYPLTFGAGTKLELK

SEQ ID NO: 267 - protein, 118 aa, Artificial Sequence
  232D7C8-VH
QAYLQQSGAELVRSGASVKMSCKASGYTFTSHNMHWVKQTPGQGLEWIGYIYPGNGGTNYNQKFKGKATLTADTSSSTAYMQISSLTSEDSAVYFCARDYFGNSFAYWGQGTLVTVSA

SEQ ID NO: 268 - protein, 113 aa, Artificial Sequence
  232D7C8-VL
DILMTQSPSSLTATAGEKVSMSCKSSQSLFNSGNQRNYLTWYQQRPGQPPKLLIYWASTRESGVPDRFTGSGSGTDFTLTISSVQAEDLAVYYCQNDYRYPFTFGAGTKLELK

SEQ ID NO: 269 - protein, 118 aa, Artificial Sequence
  233D5E5-VH
QAYLQQSGAELVRSGASVKMSCKASGYTFTSHNMHWVKQTPRQGLEWIGYIYPGNGDTNYNQKFKGKATLTADTSSSTAYMQISSLTSEDSAVYFCTRDYYGNSFAYWGQGTLVTVSA

SEQ ID NO: 270 - protein, 113 aa, Artificial Sequence
  233D5E5-VL
DIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNAYWYPFTFGAGTKLELK

SEQ ID NO: 271 - protein, 117 aa, Artificial Sequence
  232F1E4-VH
QVQLKESGPGLVAPSQSLSITCTVSGFALTTYGVSWVRQPPGKGLEWLGVIWGDGSTHYHSALISRLSIRKDNSKSQVFLKLNSLQTDDTATYYCAKPGRGNAMDYWGQGTSVTVSS

SEQ ID NO: 272 - protein, 113 aa, Artificial Sequence
  232F1E4-VL
DIVMSQSPSSLTVTAGEKVTMSCKSSQSLLNSGNQKNYLTWYQQKPGQSPKLLIYWASTRESGVPDRFTGSGSGTDFTLTISSMQAEDLAVYYCQNDYIYPLTFGAGTMLELK

SEQ ID NO: 273 - protein, 118 aa, Artificial Sequence
  231H4G11-VH
QAYLQQSGAELVRSGASVKMSCKASGYTFTSHNIHWVKQTPGQGLEWIGYISPGNGYTNYNQKFRGKATLTADTSSSTAYMQISSLTSEDSAVYFCTRDYYGNSFAYWGQGTLVTVSA

SEQ ID NO: 274 - protein, 113 aa, Artificial Sequence
  231H4G11-VL
DIVMTQSPSSLTEKAGERVSMSCKSSQSLFNSGSQKNYLTWYQQKPGQPPKLLIYWASTRESGVPDRFSGSGSGTDFTLTISSVQAEDLAVYYCQNNYWFPFTFGAGTKLELK

SEQ ID NO: 275 - protein, 115 aa, Artificial Sequence
  226A4B5-VH
QAYLQQSGAELVRSGASVRMSCKASGFTFTSYNIHWVKQTPGQGLEWIGYIYPGSGGSNYNQKFMGKATLTADTSSSTVYMQISSLTSEDSAVYFCATGRGFAYWGQGTLVTVSA

SEQ ID NO: 276 - protein, 113 aa, Artificial Sequence
  226A4B5-VL
DIVMTQSPSSLTVTAGEKVTMSCKSSQSLFNSGNQKNYLTWYQQKPGQPPKLLIYRASTRESGVPDRFTGSGSGTDFTLTISSVQAEDLAVYYCQNDYSYPLTFGTGTKLELK

SEQ ID NO: 277 - protein, 118 aa, Artificial Sequence
  235A10C9-VH
QAYLQQSGAELVRSGASVKMSCKASGYTFASHNMHWVKQTPGQGLEWIGYIYPGNSGTKYNQKFTGKATLTADTSSSTAYMQITSLTSEDSAVYFCARDYYGNSFAYWGQGTLVTVSA

SEQ ID NO: 278 - protein, 113 aa, Artificial Sequence; identical to SEQ ID NO: 2
  235A10C9-VL

SEQ ID NO: 279 - protein, 118 aa, Artificial Sequence
  239H12G9-VH
QAYLQQSGAELVRSGASVKMSCKASGYTFTSHNIHWVKQTPGQGLEWIGYIYPGNGAPNYNQKFRGKATLTADTSSSTAYMQISSLTSEDSAVYFCARDYYGNSFVYWGQGTLVTVSA

SEQ ID NO: 280 - protein, 113 aa, Artificial Sequence
  239H12G9-VL
DIVMTQSPSSLTEKAGEKVSMSCKSSQSLLNSGNQKNYLTWYQQKPGQPPKLLIYWASTRESGVPDRFTGSGSGTDFTLTISSVQAEDLAVYYCQNDYRYPFTFGAGTKLELK

SEQ ID NO: 281 - protein, 118 aa, Artificial Sequence
  240F8G2-VH
QAYLQQSGAELVRSGASVKMSCKASGYTFTNYNIHWVKQTPGQGLEWIGYIYPGNGGNYYNQKFKGKATLTADTSSSTAYMQISSLTSEDSAVYFCARDYYGNSFAYWGQGTLVTVSA

SEQ ID NO: 282 - protein, 113 aa, Artificial Sequence
  240F8G2 -VL
DIVVTQSPSSLTVTAGEKVTMNCKSSQSLLNSGNQKNYLTWYQQKPGQPPKLLIYWASTRESGVPDRFTGSGSGTDFTLTISSVQAEDLAIYYCQNDYYYPLTFGAGTKLELK

SEQ ID NO: 283 - protein, 118 aa, Artificial Sequence
  248E6A7-VH
QAYLQQSGAELVRSGASVKMSCRASGYTFTSHNMHWVKQTPGQGLEWIGYIYPGNGNTYYNQKFKVKATLTADTSSNTAYMQINSLTSEDSAVYFCVRDYYGNSFVYWGQGTLVTVSA

SEQ ID NO: 284 - protein, 113 aa, Artificial Sequence
  248E6A7-VL
DVVMTQSPSSLTEKTGEKVTMTCKSSQSLLNSGNQKNYLAWYQQKPGQPPKLLIYWASTRESGVPDRFIGSGSGTDFTLTISSLQTEDLAVYYCQNNYMYPFTFGAGTKLELK

SEQ ID NO: 285 - protein, 118 aa, Artificial Sequence
  254A8D5-VH
EVMLVESGGGLVKPGGSLKLSCAASGFTFSSYTVSWVRQTPEKRLEWVATSIVGSTYTYFPDSVKGRFTISRDFAKNTLFLQMSSLRSEDTAMYYCSRLGRGNAMDYWGQGTSVSVSS

SEQ ID NO: 286 - protein, 113 aa, Artificial Sequence
  254A8D5-VL
DIVMTQSPSSLTVTAGEKVTLNCRSSQSLLNSGNQKNYLTWYQQKPGQPPKLLIYWASTRESGVPDRFTGSGSGTDFTLTISSVQADDLAVYYCQNGYSYPFTFGSGTKLEIK

SEQ ID NO: 287 - protein, 118 aa, Artificial Sequence
  259C6F4 -VH
QAYLQQSGAELVRSGASVKMSCKASGYTFSSHNIHWVKQTPGQGLEWIGYIYPGNGDTNYNQKFKGKATLTADTSSSTAYMQISSLTSEDSAVYFCARDYYGNSFVYWGQGTLVTVSA

SEQ ID NO: 288 - protein, 113 aa, Artificial Sequence
  259C6F4-VL
DIVMIQSPSSLTEKAGEKVSMSCKSSQSLLNSGNQKNYLTWYQQKPGQPPKLLIYWASTRESGVPDRFTGSGSGTDFTLTISSVQAEDLAVYYCQNAYRFPFTFGAGTKLELK

SEQ ID NO: 289 - protein, 118 aa, Artificial Sequence; identical to SEQ ID NO: 5
  280F3B6-VH

SEQ ID NO: 290 - protein, 113 aa, Artificial Sequence
  280F3B6-VL
DIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNDYWYPFTFGAGTKLELK

SEQ ID NO: 291 - protein, 21 aa, Artificial Sequence
  CD8 signal peptide
MALPVTALLLPLALLLHAARP

SEQ ID NO: 292 - protein, 45 aa, Artificial Sequence
  CD8 hinge
TTTPAPRPPTPAPTIASQPLSLRPEACRPAAGGAVHTRGLDFACD

SEQ ID NO: 293 - protein, 24 aa, Artificial Sequence
  CD8 transmembrane domain
IYIWAPLAGTCGVLLLSLVITLYC

SEQ ID NO: 294 - protein, 42 aa, Artificial Sequence
  4-1BB (CD137) cytoplasmic domain
KRGRKKLLYIFKQPFMRPVQTTQEEDGCSCRFPEEEEGGCEL

SEQ ID NO: 295 - protein, 41 aa, Artificial Sequence
  CD28 cytoplasmic domain
RSKRSRLLHSDYMNMTPRRPGPTRKHYQPYAPPRDFAAYRS

SEQ ID NO: 296 - protein, 112 aa, Artificial Sequence
  CD3 (CD3z) cytoplasmic domain
RVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 297 - protein, 18 aa, Artificial Sequence
  Linker 1
GSTSGSGKPGSGEGSTKG

SEQ ID NO: 298 - protein, 2 aa, Artificial Sequence
  Linker 2
TS

SEQ ID NO: 299 - protein, 490 aa, Artificial Sequence
  C182001 amino acid sequence
MALPVTALLLPLALLLHAARPDIVMTQSHKFMSTSVGDRVSITCKASQDVSTAVAWYQQKPGQSPKLLIYSASYRYTGVPDRFTGSGSGTDFTFTISSVQAEDLAVYYCQQHYSTPRTFGGGTKLEIKGSTSGSGKPGSGEGSTKGQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARYGGLRRYFDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 300 - protein, 495 aa, Artificial Sequence
  C182002 amino acid sequence
MALPVTALLLPLALLLHAARPDIVMTQSPSSLTVTVGEKVTMSCKSSQSLLNSGNQKNYLTWYQQKPGQPPKLLIYWASTRESGVPDRFTGSGSETDFTLTISSLQAEDLAVYYCQNSYSFPLTFGGGTNLEIKGSTSGSGKPGSGEGSTKGQIQLVQSGPELKKPGETVRISCKASGYTFTTAGMQWVQKMPGKGLKWIGWINTHSRVPNFAEDFKGRFAFSLETSARIAYLQISNIKNEDMATYFCARLGKGNTMDFWGQGTSVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 301 - protein, 496 aa, Artificial Sequence
  C182003 amino acid sequence
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYSCQNAYSYPFTFGAGTKLELKGSTSGSGKPGSGEGSTKGEVQLQQSGTVLARPGTSVKMSCKASGYRFTSSWMHWVKQRPGQGLEWIGANYPGKSDTTYTQKFKGKARLTAVTSASTAYMELSSLTNEDSAVYYCARGAYYGNAMDYWGQGTSVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 302 - protein, 494 aa, Artificial Sequence
  C182004 amino acid sequence
MALPVTALLLPLALLLHAARPDIVMTQSPSSLTVTAGEKVTMSCKSSQSLFNSGNLKNYLTWYQQKPGQPPKLLICWASTRESGVPDRFTGSGSGTEFTLTISSVQAEDLAVYYCQNDYSYPFTFGSGTKLEIKGSTSGSGKPGSGEGSTKGQVQLKESGPGLVAPSQSLSITCTVSGFSLTDYGVSWIRQPPGKGLEWLGVIWGGGSTYYNSALKSRLIISKDNSKSQVFLKMNSLQTDDTAIYYCAKHHYGNACDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 303 - protein, 495 aa, Artificial Sequence
  C182005 amino acid sequence
MALPVTALLLPLALLLHAARPDIVLTQSPSSLTVTAGEKVTMSCKSSQSLLNSGNLRNYLTWYQQKPGQPPKLLIYWASTRESGVPDRFTGSGSGTDFTLTISSLQAEDLAIYYCQNGYSYPFTFGSGTKLEIKGSTSGSGKPGSGEGSTKGEVKLVESGGGLVQPGGSRKLSCAASGFTFRDYGMAWVRQAPGKGPEWITFISNLAYSIYYADTVTGRFTISTENAKNTLYLEMSSLRSEDTAMYYCAVIYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 304 - protein, 494 aa, Artificial Sequence
  C182006 amino acid sequence
MALPVTALLLPLALLLHAARPDIVMTQSPSSLTVTAGEKVTMSCKSSQSLLNSGNQKSYLTWYQQRPGQPPKLLIYWASTRESGVPDRFTGSGSGTDFTLTISSVQAEDLAVYFCQNVYFFPFTFGSGTKLETKGSTSGSGKPGSGEGSTKGQVQLKESGPGLVAPSQSLSITCTVSGFSLTSYGVSWVRQPPGKGLECLGVIWAGGNTNYNSALMSRLSISKDKSKSQVFLKMNSLQTDDTAMYYCARVYYGNAMDYWGQGTSVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 305 - protein, 492 aa, Artificial Sequence
  C182007 amino acid sequence
MALPVTALLLPLALLLHAARPDIVMTQSPSSLTVTPGEKVTMSCKSSQSLFNSGNQKNYLIWYQQKPGQPPKLLIYRASTRDSGVPDRFTGSGSGTDFTLTISNVQAEDLAIYYCQNDYSYPLTFGAGTKLELKGSTSGSGKPGSGEGSTKGQAYLQQSGAELVRSGASVKMSCKASGFTFTSYNIHWVKQTPGQGLEWIGYISPGNGGSNYNLKFKDKATLTSATSSSTAYMQISSLTSEDSAVYFCATGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 306 - protein, 495 aa, Artificial Sequence
  C182008 amino acid sequence
MALPVTALLLPLALLLHAARPDIMMTQSPSSLTETAGEKVSMSCKSSQSLLNSGNQKNYLTWYQQKPGQPPKLLIYWASTRESGVPDRFSGSGSGTDFTLTISSVQAEDLAVYYCQNGYRFPFTFGAGTKLELKGSTSGSGKPGSGEGSTKGQAYLQQSGAELVRSGASVKMSCKASGYTFTSHNIHWIKQTPGKGLEWIGYIYPGNGGTNYNQKFKAKATLTADTSSSTAYMQISSLTSEDSAVYFCARDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 307 - protein, 495 aa, Artificial Sequence
  C182009 amino acid sequence
MALPVTALLLPLALLLHAARPDIVMTQSPSSLTEKVGERVSMSCKSSQSLFNSGNQKNYLTWYQQKPGQPPKLLIYWASTRESGVPDRFTGSGSGTDFTLTISSVQAEDLAVYYCQNDYWYPFTFGAGTKLELKGSTSGSGKPGSGEGSTKGQAYLQQSGAELVRSGASVKMSCKASGYTFTSHNMHWVKQTPGQGLEWIGYIYPGNGRTNYNQKFKGKATLTADTSSSTAYMQISSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 308 - protein, 495 aa, Artificial Sequence
  C182010 amino acid sequence
MALPVTALLLPLALLLHAARPDIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNDYRYPFTFGAGTKLELKGSTSGSGKPGSGEGSTKGQAYLQQSGAELVRSGASVKMSCKASGYTFTSHNMHWVKQTPGQGLEWIGYIYPGNGGTNYNQKFKGKATLTADTSSSTAYMQINSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 309 - protein, 492 aa, Artificial Sequence
  C182011 amino acid sequence
MALPVTALLLPLALLLHAARPDIVMTQSPSSLTVTAGEKVTMTCKSSQSLLNSGNQKNYLTWYQQKPGQPPKVLISRASTRQSGVPDRFTGSGSGTDFTLTISSVQAEDLAVYYCQNDYSYPLTFGAGTKLELKGSTSGSGKPGSGEGSTKGEIQLQQSGPELMKPGASVKMSCKASGYSFTSYYIHWVKQSHGKSLEWIGYIDPFNGGTRYNQKFEGKATLTVDKSSTTAYMHLSSLTSEDSTVYYCASLRFLAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 310 - protein, 495 aa, Artificial Sequence
  C182012 amino acid sequence
MALPVTALLLPLALLLHAARPDVVMTQSPSSLTEKTGEKVSMSCKSSQSLLNSGNQKNYLTWYQQKPGQPPKLLIYWASTRESGVPDRFTGSGSGTDFTLTISSLQTEDLAIYYCQNNFRYPFTFGAGTKLELKGSTSGSGKPGSGEGSTKGQTYLQQSGAELVRSGASVKMSCRTSGYSFTSHNMHWVKQTPGQGLEWIGYIYPGNGGSYYNQKFKGKAILTADTSSSTAYMQISSLTSEDSAVYFCTRDYYGNSFVYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 311 - protein, 495 aa, Artificial Sequence
  C182013 amino acid sequence
MALPVTALLLPLALLLHAARPDIVMTQSPSSLTEKAGEKVSMRCKSSQSLLNSGNQKNYLTWYQQKPGQPPKLLIYWASTRESGVPDRFTGSGSGTDFTLTISSVQADDLAVYYCQNDYMFPFTFGAGTKLELKGSTSGSGKPGSGEGSTKGQADLQQSGAELVRSGASVKMSCKASGYTFASHNMHWVKQTPGQGLEWIGYIYPGNGGTKYNQKFTGKATLTADTSSSTAYMQITSLTSEDSAVYFCARDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 312 - protein, 495 aa, Artificial Sequence
  C182014 amino acid sequence
MALPVTALLLPLALLLHAARPDIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNNYWFPFTFGAGTKLELKGSTSGSGKPGSGEGSTKGQAYLQQSGAELVRSGASVKMSCKASGYTFTSHNLHWVKQTPGQGLEWIGYIYPGNGNTNYNQKFKGKATLTADTSSSTAYMQISSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - protein, 495 aa, Artificial Sequence
  C182015 amino acid sequence
MALPVTALLLPLALLLHAARPDIVMTQSPSSLTVTAGEKVTMSCKSSQSLLNSGNQKNYLTWYQQKPGQPPKLLIYWAATRESGVPDRFAGSGSGTDFTLTISSVQAEDLAVYYCQNDYFYPFTFGAGTKLELKGSTSGSGKPGSGEGSTKGQVQLQQSGAELVKPGASVKLSCKASGYTFTSFGINWLRQRPEQGLEWIGWIFPGDGNSKYNENFKGKATLTTDKSSSTAYMQVTRLTSEDSAVYFCARFYYGNSFANWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - protein, 495 aa, Artificial Sequence
  C182016 amino acid sequence
MALPVTALLLPLALLLHAARPDIVMTQSPSSLTVTAGEKVTMSCKSSQTLLNSGNQKNYLTWYQQKPGQPPKLLIYWASTGESGVPDRFTGSGSGTDFTLTISSVQAEDLAVYFCQNAYFYPFTFGGGTKLEIKGSTSGSGKPGSGEGSTKGQVQLKESGPGLVAPSQSLSITCTVSGFSLTTYGVHWVRQPPGKGLEWLGVIWAGGSTNYNSALMSRVSINKDNSKSQVFIKMNSLQADDTALYYCARAAYYGNGLDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 315 - protein, 495 aa, Artificial Sequence
  C182017 amino acid sequence
MALPVTALLLPLALLLHAARPDIVMTQSPSSLPVTAGEKVTMSCKSSQSLLNSGNQKNYLTWYQQKPGQPPKLLIYWASTRDSGVPDRFTGSGSGTDFTLTISSVQAEDLAVYYCQNNYIYPLTFGAGTKLELKGSTSGSGKPGSGEGSTKGQVQLKQSGPGLVQPSQSLSITCTVSGFSLTRYGVHWVRQSPGKGLEWLGVIWSGGNTDYNAAFISRLNIRKDNSKSQVFFKMNSLKPNDTAIYYCARAAYFGNSFDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 316 - protein, 495 aa, Artificial Sequence
  C182018 amino acid sequence
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNNYIYPLTFGAGTKLELKGSTSGSGKPGSGEGSTKGQVQLKQSGPGLVQPSQSLSITCTVSGFSLTYYGVHWVRQSPGKGLEWLGVIWRGGNTDYNAAFISRLSINKDNSKSQVFFKMNSLQPNDTAIYYCARAAYYGNCFDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 317 - protein, 492 aa, Artificial Sequence
  C182019 amino acid sequence
MALPVTALLLPLALLLHAARPDIVMTQSPSSLIVTPGERVTMSCKSSQSLLNSGNQKNYLTWYQQKPGQPPKLLIYRASTRESGVPDRFTGSGSGTDFTLTISSVQAEDLAVYYCQNDYSYPLTFGIGTKLELKGSTSGSGKPGSGEGSTKGQAYLQQSGAELVRSGASVKMSCKASGYPFTSYNMHWVKQTPGQGLEWVGYIYPGNGGTNYNQKFRDKATLTADTSSSTAYMQISRLTSDDSAVYFCLTGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 318 - protein, 492 aa, Artificial Sequence
  C182020 amino acid sequence
MALPVTALLLPLALLLHAARPDIVMTQSPSSLTVTAGEKVTMNCKSSQSLFNSGNQKNYLTWYQQKPGQPPKLLIYRASTRESGVPDRFTGSGSGTDFTLTISSVQAEDLAVYYCQNDYSYPLTFGVGTKLELKGSTSGSGKPGSGEGSTKGQAYLQQSGAELVRSGASVKMSCKASGYTFSSYNMHWVKQTPGQGLEWIGYIYPGNGGTNYNQKFKGKATLTADTSSSTAYMQISSLTSEDSAVYFCLTGRGFTYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 319 - protein, 492 aa, Artificial Sequence
  C182021 amino acid sequence
MALPVTALLLPLALLLHAARPDIVMTQSPSSLTVTAGEKVTLSCKSSQSLFNTGNQKNYLTWYQQKPGQPPKLLIFRASTRESGVPDRFTGSGFGTDFTLTISSVQAEDLAVYYCQNDFSYPLTFGAGTKLELKGSTSGSGKPGSGEGSTKGQAYLQQSGAELVRSGASVKMSCKASGYTFTSYNMHWVRQTPGQGLEWIGYIYPGNGGTNYSQKFKGKASLTADTSSTTAYMQISSLTSEDSAVYFCATGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 320 - protein, 495 aa, Artificial Sequence
  C182022 amino acid sequence
MALPVTALLLPLALLLHAARPDIVMTQFPSSLTVTAGEKVTMTCKSSQSLLNGGNQKNYLTWYQQKPGLPPKLLIYWASTRESGVPDRFTGSGSGTEFTLTISSVQAEDLAVYYCQNNYYFPLTFGAGTKLELKGSTSGSGKPGSGEGSTKGQIQWVQSGPELKKPRETVKISCKASGYTFTDYSMHWVKQAPGKGLKWMGWINSETGEATYADDFRGRFALSLETSATTAFLQINSLKNEDTGTYFCARFYYGNSFASWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 321 - protein, 492 aa, Artificial Sequence
  C182023 amino acid sequence
MALPVTALLLPLALLLHAARPDIVMTQSPSSLTVTAGERVTMSCKSSQSLFNSGNQKNYLTWYQQKPGQPPKLLIYRASTRESGVPDRFTGSGSGTDFTLTISSVQAEDLAVYYCQNDYSYPLTFGVGTKLELKGSTSGSGKPGSGEGSTKGQAYLQQSGAELVRSGASVRMSCKASGYTFSSYNMHWVKQTPGQGLEWIGYIYPGNGGTNYNQKFKDKATLTADTSSSTAFIQISSLTSEDSAVYFCLTGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 322 - protein, 492 aa, Artificial Sequence
  C182024 amino acid sequence
MALPVTALLLPLALLLHAARPDIVMTQSPSSLTVTPGEKVTMSCKSSQSLFNSGNQKNYLIWYQQKPGQPPKLLIYRASTRDSGVPDRFTGSGSGTDFTLTISNVQAEDLAVYYCQNDYSYPLTFGAGTKLELKGSTSGSGKPGSGEGSTKGQTYLQQSGAELVRSGASVKMSCKASGYTFTSYNIHWVKQTPGQGLEWIGYISPGNGGTYYNLKFKDKATLTTATSSSTAYMQISSLTSEDSAVYFCATGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 323 - protein, 492 aa, Artificial Sequence
  C182025 amino acid sequence
MALPVTALLLPLALLLHAARPDIVMTQSPSSLTVTAGEKVTMSCKSSQSLLNSGNQKNYLTWYQQKPGQPPKLLIYRASTRESGVPDRFTGSGFGTDFTLTISSVQAEDLAVYYCQNDYSYPLTFGAGTKLELKGSTSGSGKPGSGEGSTKGQAYVQQSGAELVRSGASVKMSCRASGYTFTSYNMHWVKQTPGQGLEWIGYIYPGNGGTYYNQKFKGKATLTADTSSSTAYMQISSLTSEDSAVYFCATGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 324 - protein, 495 aa, Artificial Sequence
  C182026 amino acid sequence
MALPVTALLLPLALLLHAARPDILMTQSPSSLTATAGEKVSMSCKSSQSLFNSGNQRNYLTWYQQRPGQPPKLLIYWASTRESGVPDRFTGSGSGTDFTLTISSVQAEDLAVYYCQNDYRYPFTFGAGTKLELKGSTSGSGKPGSGEGSTKGQAYLQQSGAELVRSGASVKMSCKASGYTFTSHNMHWVKQTPGQGLEWIGYIYPGNGGTNYNQKFKGKATLTADTSSSTAYMQISSLTSEDSAVYFCARDYFGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 325 - protein, 495 aa, Artificial Sequence
  C182027 amino acid sequence
MALPVTALLLPLALLLHAARPDIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNAYWYPFTFGAGTKLELKGSTSGSGKPGSGEGSTKGQAYLQQSGAELVRSGASVKMSCKASGYTFTSHNMHWVKQTPRQGLEWIGYIYPGNGDTNYNQKFKGKATLTADTSSSTAYMQISSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 326 - protein, 494 aa, Artificial Sequence
  C182028 amino acid sequence
MALPVTALLLPLALLLHAARPDIVMSQSPSSLTVTAGEKVTMSCKSSQSLLNSGNQKNYLTWYQQKPGQSPKLLIYWASTRESGVPDRFTGSGSGTDFTLTISSMQAEDLAVYYCQNDYIYPLTFGAGTMLELKGSTSGSGKPGSGEGSTKGQVQLKESGPGLVAPSQSLSITCTVSGFALTTYGVSWVRQPPGKGLEWLGVIWGDGSTHYHSALISRLSIRKDNSKSQVFLKLNSLQTDDTATYYCAKPGRGNAMDYWGQGTSVTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 327 - protein, 495 aa, Artificial Sequence
  C182029 amino acid sequence
MALPVTALLLPLALLLHAARPDIVMTQSPSSLTEKAGERVSMSCKSSQSLFNSGSQKNYLTWYQQKPGQPPKLLIYWASTRESGVPDRFSGSGSGTDFTLTISSVQAEDLAVYYCQNNYWFPFTFGAGTKLELKGSTSGSGKPGSGEGSTKGQAYLQQSGAELVRSGASVKMSCKASGYTFTSHNIHWVKQTPGQGLEWIGYISPGNGYTNYNQKFRGKATLTADTSSSTAYMQISSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 328 - protein, 492 aa, Artificial Sequence
  C182030 amino acid sequence
MALPVTALLLPLALLLHAARPDIVMTQSPSSLTVTAGEKVTMSCKSSQSLFNSGNQKNYLTWYQQKPGQPPKLLIYRASTRESGVPDRFTGSGSGTDFTLTISSVQAEDLAVYYCQNDYSYPLTFGTGTKLELKGSTSGSGKPGSGEGSTKGQAYLQQSGAELVRSGASVRMSCKASGFTFTSYNIHWVKQTPGQGLEWIGYIYPGSGGSNYNQKFMGKATLTADTSSSTVYMQISSLTSEDSAVYFCATGRGFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 329 - protein, 495 aa, Artificial Sequence
  C182031 amino acid sequence
MALPVTALLLPLALLLHAARPDIVMTQSPSSLTEKAGEKVSMRCKSSQSLLNSGNQKNYLTWYQQKPGQPPKLLIYWASTRESGVPDRFTGSGSGTDFTLTISSVQADDLAVYYCQNDYMFPFTFGAGTKLELKGSTSGSGKPGSGEGSTKGQAYLQQSGAELVRSGASVKMSCKASGYTFASHNMHWVKQTPGQGLEWIGYIYPGNSGTKYNQKFTGKATLTADTSSSTAYMQITSLTSEDSAVYFCARDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 330 - protein, 495 aa, Artificial Sequence
  C182032 amino acid sequence
MALPVTALLLPLALLLHAARPDIVMTQSPSSLTEKAGEKVSMSCKSSQSLLNSGNQKNYLTWYQQKPGQPPKLLIYWASTRESGVPDRFTGSGSGTDFTLTISSVQAEDLAVYYCQNDYRYPFTFGAGTKLELKGSTSGSGKPGSGEGSTKGQAYLQQSGAELVRSGASVKMSCKASGYTFTSHNIHWVKQTPGQGLEWIGYIYPGNGAPNYNQKFRGKATLTADTSSSTAYMQISSLTSEDSAVYFCARDYYGNSFVYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 331 - protein, 495 aa, Artificial Sequence
  C182033 amino acid sequence
MALPVTALLLPLALLLHAARPDIVVTQSPSSLTVTAGEKVTMNCKSSQSLLNSGNQKNYLTWYQQKPGQPPKLLIYWASTRESGVPDRFTGSGSGTDFTLTISSVQAEDLAIYYCQNDYYYPLTFGAGTKLELKGSTSGSGKPGSGEGSTKGQAYLQQSGAELVRSGASVKMSCKASGYTFTNYNIHWVKQTPGQGLEWIGYIYPGNGGNYYNQKFKGKATLTADTSSSTAYMQISSLTSEDSAVYFCARDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 332 - protein, 495 aa, Artificial Sequence
  C182034 amino acid sequence
MALPVTALLLPLALLLHAARPDVVMTQSPSSLTEKTGEKVTMTCKSSQSLLNSGNQKNYLAWYQQKPGQPPKLLIYWASTRESGVPDRFIGSGSGTDFTLTISSLQTEDLAVYYCQNNYMYPFTFGAGTKLELKGSTSGSGKPGSGEGSTKGQAYLQQSGAELVRSGASVKMSCRASGYTFTSHNMHWVKQTPGQGLEWIGYIYPGNGNTYYNQKFKVKATLTADTSSNTAYMQINSLTSEDSAVYFCVRDYYGNSFVYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 333 - protein, 495 aa, Artificial Sequence
  C182035 amino acid sequence
MALPVTALLLPLALLLHAARPDIVMTQSPSSLTVTAGEKVTLNCRSSQSLLNSGNQKNYLTWYQQKPGQPPKLLIYWASTRESGVPDRFTGSGSGTDFTLTISSVQADDLAVYYCQNGYSYPFTFGSGTKLEIKGSTSGSGKPGSGEGSTKGEVMLVESGGGLVKPGGSLKLSCAASGFTFSSYTVSWVRQTPEKRLEWVATSIVGSTYTYFPDSVKGRFTISRDFAKNTLFLQMSSLRSEDTAMYYCSRLGRGNAMDYWGQGTSVSVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 334 - protein, 495 aa, Artificial Sequence
  C182036 amino acid sequence
MALPVTALLLPLALLLHAARPDIVMIQSPSSLTEKAGEKVSMSCKSSQSLLNSGNQKNYLTWYQQKPGQPPKLLIYWASTRESGVPDRFTGSGSGTDFTLTISSVQAEDLAVYYCQNAYRFPFTFGAGTKLELKGSTSGSGKPGSGEGSTKGQAYLQQSGAELVRSGASVKMSCKASGYTFSSHNIHWVKQTPGQGLEWIGYIYPGNGDTNYNQKFKGKATLTADTSSSTAYMQISSLTSEDSAVYFCARDYYGNSFVYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 335 - protein, 495 aa, Artificial Sequence
  C182037 amino acid sequence
MALPVTALLLPLALLLHAARPDIVMTQSPSSLTEKAGERVSMSCKSSQSLFNSGNQKNYLTWYQQKPGQPPKLLIYWASTRESGVPDRFTGSGSGTDFTLTISSVQAEDLAVYYCQNDYWYPFTFGAGTKLELKGSTSGSGKPGSGEGSTKGQAYLQQSGAELVRSGASVKMSCKASGYTFTSHNMHWVKQTPGQGLEWIGYIYPGNGGTNYNQKFKGKATLTADTSSSTAYMQISSLTSEDSAVYFCTRDYYGNSFAYWGQGTLVTVSATSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 336 - protein, 495 aa, Artificial Sequence
  175DX amino acid sequence
MALPVTALLLPLALLLHAARPDIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIKGSTSGSGKPGSGEGSTKGQVQLQQPGAELVRPGASVKLSCKASGYTFTSYWINWVKQRPGQGLEWIGNIYPSDSYTNYNQKFKDKATLTVDKSSSTAYMQLSSPTSEDSAVYYCTRSWRGNSFDYWGQGTTLTVSSTSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 337 - protein, 115 aa, Artificial Sequence
  Humanized 207F8G5-VH1
QVQLVQSGAEVKKPGASVKVSCKASGFTFTSYNIHWVRQAPGQGLEWMGYISPGNGGSNYNLKFKDRVTMTRDTSISTAYMELSRLRSDDTAVYYCARGRGFAYWGQGTLVTVSS

SEQ ID NO: 338 - protein, 115 aa, Artificial Sequence
  Humanized 207F8G5-VH1.1
QVQLVQSGAEVKKPGASVKVSCKASGFTFTSYNIHWVKQAPGQGLEWMGYISPGNGGSNYNLKFKDRVTMTSDTSISTAYMELSRLRSDDTAVYFCATGRGFAYWGQGTLVTVSS

SEQ ID NO: 339 - protein, 115 aa, Artificial Sequence
  Humanized 207F8G5-VH1.2
QVQLVQSGAEVKKPGASVKVSCKASGFTFTSYNIHWVKQAPGQGLEWIGYISPGNGGSNYNLKFKDRATMTRDTSISTAYMELSRLRSDDTAVYFCATGRGFAYWGQGTLVTVSS

SEQ ID NO: 340 - protein, 115 aa, Artificial Sequence
  Humanized 207F8G5-VH1.3
QVQLVQSGAEVKKPGASVKVSCKASGFTFTSYNIHWVRQAPGQGLEWIGYISPGNGGSNYNLKFKDRATMTSDTSISTAYMELSRLRSDDTAVYFCATGRGFAYWGQGTLVTVSS

SEQ ID NO: 341 - protein, 115 aa, Artificial Sequence
  Humanized 207F8G5-VH1.4
QVQLVQSGAEVKKPGASVKVSCKASGFTFTSYNIHWVKQAPGQGLEWIGYISPGNGGSNYNLKFKDRATMTSDTSISTAYMELSRLRSDDTAVYFCATGRGFAYWGQGTLVTVSS

SEQ ID NO: 342 - protein, 115 aa, Artificial Sequence
  Humanized 207F8G5-VH1.5
QVQLVQSGAEVKKPGASVKVSCKASGFTFTSYNIHWVKQAPGQGLEWMGYISPGNGGSNYNLKFKDRVTLTSDTSISTAYMELSRLRSDDTAVYFCATGRGFAYWGQGTLVTVSS

SEQ ID NO: 343 - protein, 115 aa, Artificial Sequence
  Humanized 207F8G5-VH1.6
QVQLVQSGAEVKKPGASVKVSCKASGFTFTSYNIHWVKQAPGQGLEWIGYISPGNGGSNYNLKFKDRATMTSDTSSSTAYMELSRLRSDDTAVYFCATGRGFAYWGQGTLVTVSS

SEQ ID NO: 344 - protein, 115 aa, Artificial Sequence
  Humanized 207F8G5-VH1.7
QVQLVQSGAEVKKPGASVKVSCKASGFTFTSYNIHWVKQAPGQGLEWMGYISPGNGGSNYNLKFKDRVTLTSDTSISTAYMELSRLRSDDTAVYYCATGRGFAYWGQGTLVTVSS

SEQ ID NO: 345 - protein, 115 aa, Artificial Sequence
  Humanized 207F8G5-VH1.8
QVQLVQSGAEVKKPGASVKMSCKASGFTFTSYNIHWVKQAPGQGLEWIGYISPGNGGSNYNLKFKDRATLTSDTSSSTAYMELSRLRSDDTAVYFCATGRGFAYWGQGTLVTVSS

SEQ ID NO: 346 - protein, 113 aa, Artificial Sequence
  Humanized 207F8G5-VL1
DIVMTQSPDSLAVSLGERATINCKSSQSLFNSGNQKNYLIWYQQKPGQPPKLLIYRASTRDSGVPDRFSGSGSGTDFTLTISSLQAEDVAVYYCQNDYSYPLTFGGGTKLEIK

SEQ ID NO: 347 - protein, 113 aa, Artificial Sequence
  Humanized 207F8G5-VL1.1
DIVMTQSPDSLAVSPGERATMSCKSSQSLFNSGNQKNYLIWYQQKPGQPPKLLIYRASTRDSGVPDRFSGSGSGTDFTLTISSLQAEDVAVYYCQNDYSYPLTFGGGTKLEIK

SEQ ID NO: 348 - protein, 118 aa, Artificial Sequence
  Humanized 232C5E3-VH1
QVQLVQSGAEVKKPGASVKVSCKASGYTFTSHNIHWVRQAPGQRLEWMGYIYPGNGGTNYNQKFKARVTITRDTSASTAYMELSSLRSEDTAVYYCARDYYGNSFAYWGQGTLVTVSS

SEQ ID NO: 349 - protein, 118 aa, Artificial Sequence
  Humanized 232C5E3-VH1.1
QVQLVQSGAEVKKPGASVKVSCKASGYTFTSHNIHWVRQAPGQRLEWIGYIYPGNGGTNYNQKFKARATITADTSASTAYMELSSLRSEDTAVYFCARDYYGNSFAYWGQGTLVTVSS

SEQ ID NO: 350 - protein, 118 aa, Artificial Sequence
  Humanized 232C5E3-VH1.2
QVQLVQSGAEVKKPGASVKVSCKASGYTFTSHNIHWIKQAPGQRLEWMGYIYPGNGGTNYNQKFKARVTITADTSASTAYMELSSLRSEDTAVYFCARDYYGNSFAYWGQGTLVTVSS

SEQ ID NO: 351 - protein, 118 aa, Artificial Sequence
  Humanized 232C5E3-VH1.3
QVQLVQSGAEVKKPGASVKVSCKASGYTFTSHNIHWVRQAPGQRLEWIGYIYPGNGGTNYNQKFKARVTITADTSASTAYMELSSLRSEDTAVYFCARDYYGNSFAYWGQGTLVTVSS

SEQ ID NO: 352 - protein, 118 aa, Artificial Sequence
  Humanized 232C5E3-VH1.4
QVQLVQSGAEVKKPGASVKVSCKASGYTFTSHNIHWIKQAPGQRLEWIGYIYPGNGGTNYNQKFKARATITADTSASTAYMELSSLRSEDTAVYFCARDYYGNSFAYWGQGTLVTVSS

SEQ ID NO: 353 - protein, 113 aa, Artificial Sequence
  Humanized 232C5E3-VL1
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNGYRFPFTFGQGTKLEIK

SEQ ID NO: 354 - protein, 113 aa, Artificial Sequence
  Humanized 232C5E3-VL1.1
DIVMTQSPDSLAVSLGERATMSCKSSQSLLNSGNQKNYLTWYQQKPGQPPKLLIYWASTRESGVPDRFSGSGSGTDFTLTISSLQAEDVAVYYCQNGYRFPFTFGQGTKLEIK

SEQ ID NO: 355 - protein, 117 aa, Artificial Sequence
  Humanized 237D2A4-VH1
QVQLQESGPGLVKPSETLSLTCTVSGFSLTSYGVSWIRQPPGKGLEWIGVIWGDGSTNYHSTLISRVTISVDTSKNQFSLKLSSVTAADTAVYYCARAGRGNALDYWGQGTLVTVSS

SEQ ID NO: 356 - protein, 117 aa, Artificial Sequence
  Humanized 237D2A4-VH1.1
QVQLQESGPGLVKPSETLSLTCTVSGFSLTSYGVSWIRQPPGKGLEWIGVIWGDGSTNYHSTLISRVTISKDTSKSQFSLKLSSVTAADTAVYYCAKAGRGNALDYWGQGTLVTVSS

SEQ ID NO: 357 - protein, 117 aa, Artificial Sequence
  Humanized 237D2A4-VH1.2
QVQLQESGPGLVKPSETLSLTCTVSGFSLTSYGVSWIRQPPGKGLEWIGVIWGDGSTNYHSTLISRVTISKDTSKNQVFLKLSSVTAADTAVYYCAKAGRGNALDYWGQGTLVTVSS

SEQ ID NO: 358 - protein, 117 aa, Artificial Sequence
  Humanized 237D2A4-VH1.3
QVQLQESGPGLVKPSETLSLTCTVSGFSLTSYGVSWIRQPPGKGLEWIGVIWGDGSTNYHSTLISRVTISKDTSKSQVFLKLSSVTAADTAVYYCAKAGRGNALDYWGQGTLVTVSS

SEQ ID NO: 359 - protein, 117 aa, Artificial Sequence
  Humanized 237D2A4-VH1.4
QVQLQESGPGLVKPSETLSLTCTVSGFSLTSYGVSWVRQPPGKGLEWIGVIWGDGSTNYHSTLISRVTISKDTSKSQFSLKLSSVTAADTAVYYCAKAGRGNALDYWGQGTLVTVSS

SEQ ID NO: 360 - protein, 117 aa, Artificial Sequence
  Humanized 237D2A4-VH1.5
QVQLQESGPGLVKPSETLSLTCTVSGFSLTSYGVSWVRQPPGKGLEWLGVIWGDGSTNYHSTLISRLTISKDTSKNQFSLKLSSVTAADTAVYYCAKAGRGNALDYWGQGTLVTVSS

SEQ ID NO: 361 - protein, 117 aa, Artificial Sequence
  Humanized 237D2A4-VH1.6
QVQLQESGPGLVKPSETLSLTCTVSGFSLTSYGVSWVRQPPGKGLEWLGVIWGDGSTNYHSTLISRLTISKDTSKSQFSLKLSSVTAADTAVYYCAKAGRGNALDYWGQGTLVTVSS

SEQ ID NO: 362 - protein, 117 aa, Artificial Sequence
  Humanized 237D2A4-VH1.7
QVQLQESGPGLVKPSETLSLTCTVSGFSLTSYGVSWVRQPPGKGLEWLGVIWGDGSTNYHSTLISRLTISKDTSKSQVFLKLSSVTAADTAVYYCAKAGRGNALDYWGQGTLVTVSS

SEQ ID NO: 363 - protein, 113 aa, Artificial Sequence
  Humanized 237D2A4-VL1
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNDYSFPLTFGGGTKLEIK

SEQ ID NO: 364 - protein, 113 aa, Artificial Sequence
  Humanized 237D2A4-VL1.1
DIVMTQSPDSLAVSLGERATMSCKSSQSLLNSGNQKNYLTWYQQKPGQPPKLLIYWASTRESGVPDRFSGSGSGTDFTLTISSLQAEDVAVYYCQNDYSFPLTFGGGTKLEIK

SEQ ID NO: 365 - protein, 118 aa, Artificial Sequence
  Humanized 246B5F2-VH1
EVQLLESGGGLVQPGGSLRLSCAASEFTFSNYAMSWVRQAPGKGLEWVSTISSGRSSTYYPDSVKGRFTISRDNSKNTLYLQMNSLRAEDTAVYYCAKLGRGNAMEYWGQGTLVTVSS

SEQ ID NO: 366 - protein, 118 aa, Artificial Sequence
  Humanized 246B5F2-VH1.1
EVQLLESGGGLVQPGGSLRLSCAASEFTFSNYAMSWVRQAPGKRLEWVATISSGRSSTYYPDSVKGRFTISRDNSKNTLYLQMNSLRAEDTAVYYCAGLGRGNAMEYWGQGTLVTVSS

SEQ ID NO: 367 - protein, 118 aa, Artificial Sequence
  Humanized 246B5F2-VH1.2
EVQLLESGGGLVQPGGSLRLSCAASEFTFSNYAMSWVRQAPGKGLEWVATISSGRSSTYYPDSVKGRFTISRDNAKNTLYLQMNSLRAEDTAVYYCAGLGRGNAMEYWGQGTLVTVSS

SEQ ID NO: 368 - protein, 118 aa, Artificial Sequence
  Humanized 246B5F2-VH1.3
EVQLLESGGGLVQPGGSLRLSCAASEFTFSNYAMSWVRQAPGKRLEWVATISSGRSSTYYPDSVKGRFTISRDNAKNTLYLQMNSLRAEDTAVYYCAGLGRGNAMEYWGQGTLVTVSS

SEQ ID NO: 369 - protein, 118 aa, Artificial Sequence
  Humanized 246B5F2-VH1.4
EVMLLESGGGLVQPGGSLRLSCAASEFTFSNYAMSWVRQAPGKRLEWVATISSGRSSTYYPDSVKGRFTISRDNAKNTLYLQMNSLRAEDTAVYYCAGLGRGNAMEYWGQGTLVTVSS

SEQ ID NO: 370 - protein, 113 aa, Artificial Sequence
  Humanized 246B5F2-VL1
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNAYSYPFTFGGGTKLEIK

SEQ ID NO: 371 - protein, 113 aa, Artificial Sequence
  Humanized 246B5F2-VL1.1
DIVMTQSPDSLAVSLGERATISCKSSQSLLNSGNQKNYLTWYQQKPGQPPKLLIYWASTRESGVPDRFTGSGSGTDFTLTISSLQAEDVAVYYCQNAYSYPFTFGGGTKLEIK

SEQ ID NO: 372 - protein, 118 aa, Artificial Sequence
  Humanized 370E2B12C3-VH1
QVQLQESGPGLVKPSETLSLTCTVSGFSLTTYGVHWIRQPPGKGLEWIGVIWAGGSTNYNSALMSRVTISVDTSKNQFSLKLSSVTAADTAVYYCARAAYYGNGLDYWGQGTMVTVSS

SEQ ID NO: 373 - protein, 118 aa, Artificial Sequence
  Humanized 370E2B12C3-VH2
EVQLVESGGGLIQPGGSLRLSCAASGFSLTTYGVHWVRQAPGKGLEWVSVIWAGGSTNYNSALMSRFTISRDNSKNTLYLQMNSLRAEDTAVYYCARAAYYGNGLDYWGQGTLVTVSS

SEQ ID NO: 374 - protein, 118 aa, Artificial Sequence
  Humanized 370E2B12C3-VH3
QVQLVESGGGVVQPGRSLRLSCAASGFSLTTYGVHWVRQAPGKGLEWVAVIWAGGSTNYNSALMSRFTISRDNSKNTLYLQMNSLRAEDTAVYYCARAAYYGNGLDYWGQGTMVTVSS

SEQ ID NO: 375 - protein, 113 aa, Artificial Sequence
  Humanized 370E2B12C3-VL1
DIVMTQSPDSLAVSLGERATINCKSSQTLLNSGNQKNYLTWYQQKPGQPPKLLIYWASTGESGVPDRFSGSGSGTDFTLTISSLQAEDVAVYYCQNAYFYPFTFGGGTKLEIK

SEQ ID NO: 376 - protein, 113 aa, Artificial Sequence
  Humanized 370E2B12C3-VL2
DIVMTQSPLSLPVTPGEPASISCKSSQTLLNSGNQKNYLTWYLQKPGQSPQLLIYWASTGESGVPDRFSGSGSGTDFTLKISRVEAEDVGVYYCQNAYFYPFTFGGGTKVEIK

SEQ ID NO: 377 - protein, 113 aa, Artificial Sequence
  Humanized 370E2B12C3-VL3
DVVMTQSPLSLPVTLGQPASISCKSSQTLLNSGNQKNYLTWFQQRPGQSPRRLIYWASTGESGVPDRFSGSGSGTDFTLKISRVEAEDVGVYYCQNAYFYPFTFGGGTKVEIK

SEQ ID NO: 378 - protein, 118 aa, Artificial Sequence
  Humanized 410H6H3-VH1
EVQLVESGGGLVQPGGSLRLSCAASGFTFSSSGMHWVRQAPGKGLEWVSYISSGSNTIYYADTLKGRFTISRDNAKNSLYLQMNSLRAEDTAVYYCARIYYGNSFVYWGQGTLVTVSS

SEQ ID NO: 379 - protein, 118 aa, Artificial Sequence
  Humanized 410H6H3-VH1.1
EVQLVESGGGLVQPGGSLRLSCAASGFTFSSSGMHWVRQAPGKGLEWVAYISSGSNTIYYADTLKGRFTISRDNAKNSLFLQMNSLRAEDTAVYYCARIYYGNSFVYWGQGTLVTVSS

SEQ ID NO: 380 - protein, 118 aa, Artificial Sequence
  Humanized 410H6H3-VH1.2
EVQLVESGGGLVQPGGSRRLSCAASGFTFSSSGMHWVRQAPGKGLEWVSYISSGSNTIYYADTLKGRFTISRDNAKNTLFLQMNSLRAEDTAVYYCARIYYGNSFVYWGQGTLVTVSS

SEQ ID NO: 381 - protein, 113 aa, Artificial Sequence
  Humanized 410H6H3-VL1
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNNYYYPLTFGQGTKLEIK

SEQ ID NO: 382 - protein, 113 aa, Artificial Sequence
  Humanized 410H6H3-VL1.1
DIVMTQSPDSLAVSLGERATMSCKSSQSLLNSGNQKNYLTWYQQKPGQPPKMLIYWASTRESGVPDRFSGSGSGTDFTLTISSLQAEDVAVYYCQNNYYYPLTFGQGTKLEIK

SEQ ID NO: 383 - protein, 118 aa, Artificial Sequence
  Humanized 412B6E4-VH1
EVQLVESGGGLVQPGGSLRLSCAASGFTFSSFGVHWVRQAPGKGLEWVSYISSGSSTIYYAHSVKGRFTISRDNAKNSLYLQMNSLRAEDTAVYYCARFYYGNSFAYWGQGTLVTVSS

SEQ ID NO: 384 - protein, 118 aa, Artificial Sequence
  Humanized 412B6E4-VH1.1
EVQLVESGGGLVQPGGSLRLSCAASGFTFSSFGVHWVRQAPGKGLEWVAYISSGSSTIYYAHSVKGRFTISRDNAKNSLFLQMNSLRAEDTAVYYCARFYYGNSFAYWGQGTLVTVSS

SEQ ID NO: 385 - protein, 118 aa, Artificial Sequence
  Humanized 412B6E4-VH1.2
EVQLVESGGGLVQPGGSRRLSCAASGFTFSSFGVHWVRQAPGKGLEWVSYISSGSSTIYYAHSVKGRFTISRDNAKNTLFLQMNSLRAEDTAVYYCARFYYGNSFAYWGQGTLVTVSS

SEQ ID NO: 386 - protein, 113 aa, Artificial Sequence
  Humanized 412B6E4-VL1
DIVMTQSPDSLAVSLGERATINCKSSQSLLNSGNQKNYLTWYQQKPGQPPKLLIYWASTRESGVPDRFSGSGSGTDFTLTISSLQAEDVAVYYCQNAYTYPLTFGQGTKLEIK

SEQ ID NO: 387 - protein, 113 aa, Artificial Sequence
  Humanized 412B6E4-VL1.1
DIVMTQSPDSLAVSLGERATMSCKSSQSLLNSGNQKNYLTWYQQKPGQPPKMLIYWASTRESGVPDRFSGSGSGTDFTLTISSLQAEDVAVYYCQNAYTYPLTFGQGTKLEIK

SEQ ID NO: 388 - protein, 330 aa, Artificial Sequence
  human IgG1 heavy chain domain
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 389 - protein, 107 aa, Artificial Sequence [sequence omitted]

SEQ ID NO: 390 - protein, 17 aa, Artificial Sequence
  260F8A6  VH CDR2
YIYPGNGNTYYNQKFKG

SEQ ID NO: 391 - protein, 17 aa, Artificial Sequence
  VH CDR2
YISSGSRPIYYADTVKG

SEQ ID NO: 392 - protein, 5 aa, Artificial Sequence
  VH CDR1
SYAMS

SEQ ID NO: 393 - protein, 17 aa, Artificial Sequence
  VH CDR2
TITSGVSHTYYFDSVKG

SEQ ID NO: 394 - protein, 9 aa, Artificial Sequence
  VH CDR3
LYYGNSLDY

SEQ ID NO: 395 - protein, 17 aa, Artificial Sequence
  VH CDR2
TISSGGSYTYYFDSVKG

SEQ ID NO: 396 - protein, 9 aa, Artificial Sequence
  VH CDR3
LYYGNALDY

SEQ ID NO: 397 - protein, 5 aa, Artificial Sequence
  VH CDR1
DYLIH

SEQ ID NO: 398 - protein, 17 aa, Artificial Sequence
  VH CDR2
WINTETGEPTYADDFKG

SEQ ID NO: 399 - protein, 9 aa, Artificial Sequence
  VH CDR3
IYYGNSFDY

SEQ ID NO: 400 - protein, 17 aa, Artificial Sequence
  VH CDR2
YISPGNGGSNYNLNFKD

SEQ ID NO: 401 - protein, 17 aa, Artificial Sequence
  VH CDR2
YIYPGNGHTNYNQKFKG

SEQ ID NO: 402 - protein, 5 aa, Artificial Sequence
  VH CDR1
NYVMC

SEQ ID NO: 403 - protein, 17 aa, Artificial Sequence
  VH CDR2
TISSGNFYTYYPDSVKG

SEQ ID NO: 404 - protein, 9 aa, Artificial Sequence
  VH CDR3
LGRGNALDN

SEQ ID NO: 405 - protein, 17 aa, Artificial Sequence
  VH CDR2
YIYPGNGDNYYNQKFKG

SEQ ID NO: 406 - protein, 5 aa, Artificial Sequence
  VH CDR1
NYGVH

SEQ ID NO: 407 - protein, 16 aa, Artificial Sequence
  VH CDR2
VIWSGGNTDYNTVFKA

SEQ ID NO: 408 - protein, 12 aa, Artificial Sequence
  VH CDR3
NLYGNYDYAMDY

SEQ ID NO: 409 - protein, 5 aa, Artificial Sequence
  VH CDR1
SYYMH

SEQ ID NO: 410 - protein, 17 aa, Artificial Sequence
  VH CDR2
YIDPFNGNTRYNQKFKD

SEQ ID NO: 411 - protein, 6 aa, Artificial Sequence
  VH CDR3
LRFFAY

SEQ ID NO: 412 - protein, 17 aa, Artificial Sequence
  VH CDR2
YIDPFSGGTRYNQKFEG

SEQ ID NO: 413 - protein, 5 aa, Artificial Sequence
  VH CDR1
TYGVT

SEQ ID NO: 414 - protein, 16 aa, Artificial Sequence
  VH CDR2
VIWGDGSTNYHSALTS

SEQ ID NO: 415 - protein, 9 aa, Artificial Sequence
  VH CDR3
PGRGNALDY

SEQ ID NO: 416 - protein, 9 aa, Artificial Sequence
  VH CDR3
DYYGNSFTY

SEQ ID NO: 417 - protein, 5 aa, Artificial Sequence
  VH CDR1
DYTMS

SEQ ID NO: 418 - protein, 17 aa, Artificial Sequence
  VH CDR2
TSIIGGTYTYYPDSVKG

SEQ ID NO: 419 - protein, 17 aa, Artificial Sequence
  VH CDR2
YINPGNGGNNYNQKFKG

SEQ ID NO: 420 - protein, 9 aa, Artificial Sequence
  VH CDR3
DYYGNSFAF

SEQ ID NO: 421 - protein, 16 aa, Artificial Sequence
  VH CDR2
VIWNRGNTYYNSALKS

SEQ ID NO: 422 - protein, 9 aa, Artificial Sequence
  VH CDR3
HDFLRFLDY

SEQ ID NO: 423 - protein, 16 aa, Artificial Sequence
  VH CDR2
VIWGGGNAYYNSALKS

SEQ ID NO: 424 - protein, 9 aa, Artificial Sequence
  VH CDR3
NGLLRYLDY

SEQ ID NO: 425 - protein, 17 aa, Artificial Sequence
  VH CDR2
LINPFNGGTTYNQKFKG

SEQ ID NO: 426 - protein, 17 aa, Artificial Sequence
  VH CDR2
YVSSGSRPIYYADTVKG

SEQ ID NO: 427 - protein, 5 aa, Artificial Sequence
  VH CDR1
SYYIY

SEQ ID NO: 428 - protein, 17 aa, Artificial Sequence
  VH CDR2
YIDPFNGNTNYNQKFKG

SEQ ID NO: 429 - protein, 11 aa, Artificial Sequence
  VH CDR3
VNGYGRGAMDY

SEQ ID NO: 430 - protein, 5 aa, Artificial Sequence
  VH CDR1
DFGMH

SEQ ID NO: 431 - protein, 9 aa, Artificial Sequence
  VH CDR3
FYFGNSFDH

SEQ ID NO: 432 - protein, 17 aa, Artificial Sequence
  VH CDR2
YISSDSRPIYYADTVKG

SEQ ID NO: 433 - protein, 5 aa, Artificial Sequence
  VH CDR1
GFGLH

SEQ ID NO: 434 - protein, 5 aa, Artificial Sequence
  VH CDR1
GFGVH

SEQ ID NO: 435 - protein, 17 aa, Artificial Sequence
  VH CDR2
YIGSGSRPIYYADTVKG

SEQ ID NO: 436 - protein, 5 aa, Artificial Sequence
  VH CDR1
SYYMY

SEQ ID NO: 437 - protein, 17 aa, Artificial Sequence
  VH CDR2
YISSGSSPIYYTDTVKG

SEQ ID NO: 438 - protein, 17 aa, Artificial Sequence
  VH CDR2
YISSGSRPIYYVDTVEG

SEQ ID NO: 439 - protein, 17 aa, Artificial Sequence
  VH CDR2
FISGGGSPIFYADSVKG

SEQ ID NO: 440 - protein, 17 aa, Artificial Sequence
  VH CDR2
FISGGGSPIFYADSVKG

SEQ ID NO: 441 - protein, 9 aa, Artificial Sequence
  VH CDR3
FYFGNSFAY

SEQ ID NO: 442 - protein, 17 aa, Artificial Sequence
  VH CDR2
YISSGSSPIYYSDTVKG

SEQ ID NO: 443 - protein, 9 aa, Artificial Sequence
  VH CDR3
IYYGNSFDH

SEQ ID NO: 444 - protein, 5 aa, Artificial Sequence
  VH CDR1
NFWMH

SEQ ID NO: 445 - protein, 17 aa, Artificial Sequence
  VH CDR2
MIDTSNGETRLNQIFKD

SEQ ID NO: 446 - protein, 6 aa, Artificial Sequence
  VH CDR3
YGNFAD

SEQ ID NO: 447 - protein, 5 aa, Artificial Sequence
  VH CDR1
SYWMH

SEQ ID NO: 448 - protein, 17 aa, Artificial Sequence
  VH CDR2
NIYPGSGSTNYDEKFKS

SEQ ID NO: 449 - protein, 12 aa, Artificial Sequence
  VH CDR3
RITTATRDYFDY

SEQ ID NO: 450 - protein, 5 aa, Artificial Sequence
  VH CDR1
SYTMS

SEQ ID NO: 451 - protein, 17 aa, Artificial Sequence
  VH CDR2
TISSGGSYTYYPDSVKG

SEQ ID NO: 452 - protein, 7 aa, Artificial Sequence
  VH CDR3
DPGYFAY

SEQ ID NO: 453 - protein, 17 aa, Artificial Sequence
  VH CDR2
YISSGGRPIYYADTVQG

SEQ ID NO: 454 - protein, 9 aa, Artificial Sequence
  VH CDR3
DYFGNSFVY

SEQ ID NO: 455 - protein, 9 aa, Artificial Sequence
  VL CDR3
QNNYRYPFT

SEQ ID NO: 456 - protein, 17 aa, Artificial Sequence
  VL CDR1
KSSQNLLNSGNQKSYLT

SEQ ID NO: 457 - protein, 7 aa, Artificial Sequence
  VL CDR2
WASTRET

SEQ ID NO: 458 - protein, 17 aa, Artificial Sequence
  VL CDR1
RSSQSLFNSGNQKNYLI

SEQ ID NO: 459 - protein, 9 aa, Artificial Sequence
  VL CDR3
QNDYYYPFT

SEQ ID NO: 460 - protein, 11 aa, Artificial Sequence
  VL CDR1
RASQSISDYLH

SEQ ID NO: 461 - protein, 7 aa, Artificial Sequence
  VL CDR2
YASQSIS

SEQ ID NO: 462 - protein, 9 aa, Artificial Sequence
  VL CDR3
QNGHSFPFT

SEQ ID NO: 463 - protein, 7 aa, Artificial Sequence
  VL CDR2
WASTRQS

SEQ ID NO: 464 - protein, 9 aa, Artificial Sequence
  VL CDR3
QNDYWFPFT

SEQ ID NO: 465 - protein, 17 aa, Artificial Sequence
  VL CDR1
NSSQSLLNSGNQKNYLT

SEQ ID NO: 466 - protein, 7 aa, Artificial Sequence
  VL CDR2
WASSRES

SEQ ID NO: 467 - protein, 9 aa, Artificial Sequence
  VL CDR3
QNDYIFPLT

SEQ ID NO: 468 - protein, 9 aa, Artificial Sequence
  VL CDR3
QNDYRFPFT

SEQ ID NO: 469 - protein, 9 aa, Artificial Sequence
  VL CDR3
LNDYYYPLT

SEQ ID NO: 470 - protein, 8 aa, Artificial Sequence
  VL CDR3
QSDYSYPT

SEQ ID NO: 471 - protein, 9 aa, Artificial Sequence
  VL CDR3
QSAFSYPLT

SEQ ID NO: 472 - protein, 10 aa, Artificial Sequence
  VL CDR1
SASSSISYMH

SEQ ID NO: 473 - protein, 7 aa, Artificial Sequence
  VL CDR2
DTSKLAS

SEQ ID NO: 474 - protein, 9 aa, Artificial Sequence
  VL CDR3
QQWSSNPLT

SEQ ID NO: 475 - protein, 17 aa, Artificial Sequence
  VL CDR1
RSSQSLLNSGNQRNYLT

SEQ ID NO: 476 - protein, 17 aa, Artificial Sequence
  VL CDR1
RSSQNLLNSGNLKNYLT

SEQ ID NO: 477 - protein, 9 aa, Artificial Sequence
  VL CDR3
QNNYFFPLT

SEQ ID NO: 478 - protein, 17 aa, Artificial Sequence
  VL CDR1
KSSQSLLNSGNQRNYLT

SEQ ID NO: 479 - protein, 17 aa, Artificial Sequence
  VL CDR1
KSSQSLFNRGNQKSYLT

SEQ ID NO: 480 - protein, 17 aa, Artificial Sequence
  VL CDR1
RSSQNLLNSGNQKNYLT

SEQ ID NO: 481 - protein, 9 aa, Artificial Sequence
  VL CDR3
QNAYSFPFT

SEQ ID NO: 482 - protein, 17 aa, Artificial Sequence
  VL CDR1
RSSQSLFNSGNQKNYLT

SEQ ID NO: 483 - protein, 9 aa, Artificial Sequence
  VL CDR3
QTGFSYPLT

SEQ ID NO: 484 - protein, 9 aa, Artificial Sequence
  VL CDR3
QTSFNYPLT

SEQ ID NO: 485 - protein, 16 aa, Artificial Sequence
  VL CDR1
RSSQSIVYGNGNTYLE

SEQ ID NO: 486 - protein, 7 aa, Artificial Sequence
  VL CDR2
KVSSRFS

SEQ ID NO: 487 - protein, 9 aa, Artificial Sequence
  VL CDR3
FQGSHVPFT

SEQ ID NO: 488 - protein, 12 aa, Artificial Sequence
  VL CDR1
SVSSSISSSNLH

SEQ ID NO: 489 - protein, 7 aa, Artificial Sequence
  VL CDR2
GTSNLAS

SEQ ID NO: 490 - protein, 9 aa, Artificial Sequence
  VL CDR3
QQWSSYPLT

SEQ ID NO: 491 - protein, 11 aa, Artificial Sequence
  VL CDR1
RASENIYSYLA

SEQ ID NO: 492 - protein, 7 aa, Artificial Sequence
  VL CDR2
NAKTLAE

SEQ ID NO: 493 - protein, 9 aa, Artificial Sequence
  VL CDR3
QHHYGTPYT

SEQ ID NO: 494 - protein, 9 aa, Artificial Sequence
  VL CDR3
QNDYMYPFT

SEQ ID NO: 495 - protein, 118 aa, Artificial Sequence
  234A10F7-VH
QVQLQQSGAELVKPGASVKLSCKASGYTFTSFGINWLRQRPEQGLEWIGWIFPGDGNSKYNENFKGKATLTTDKSSSTAYMQLTRLTSEDSAVYFCARFYYGNSFAYWGQGTLVTVSA

SEQ ID NO: 496 - protein, 113 aa, Artificial Sequence
  234A10F7-VL
DIVMTQSPSSLTVTTGQKVTMSCKSSQSLLNSGNQKNYLTWYQQKPGQPPKLLIYWAATRESGVPDRFTGSGSGTDFTLTISSVQAEDLAVYYCQNDYFYPFTFGAGTKLELK

SEQ ID NO: 497 - protein, 118 aa, Artificial Sequence
  240D6F5-VH
QAYLQQSGAELVRSGASVKMSCKASGYTFTSHNMHWVKQTPGQGLEWIGYIYPGNGGTNYNQKFKGKATLTADPSSSTAYMQINSLTSEDSAVYFCTRDYYGNSFAYWGQGTLVTVSA

SEQ ID NO: 498 - protein, 113 aa, Artificial Sequence; identical to SEQ ID NO: 4
  240D6F5-VL

SEQ ID NO: 499 - protein, 118 aa, Artificial Sequence; identical to SEQ ID NO: 3
  242H12D6-VH

SEQ ID NO: 500 - protein, 113 aa, Artificial Sequence; identical to SEQ ID NO: 4
  242H12D6-VL

SEQ ID NO: 501 - protein, 118 aa, Artificial Sequence; identical to SEQ ID NO: 17
  243B4F2-VH

SEQ ID NO: 502 - protein, 113 aa, Artificial Sequence; identical to SEQ ID NO: 18
  243B4F2-VL

SEQ ID NO: 503 - protein, 118 aa, Artificial Sequence; identical to SEQ ID NO: 17
  243B4F7-VH

SEQ ID NO: 504 - protein, 113 aa, Artificial Sequence; identical to SEQ ID NO: 18
  243B4F7-VL

SEQ ID NO: 505 - protein, 118 aa, Artificial Sequence
  243F6D2-VH
QAYLQQSGAELVRSGASVKMSCRASGYTFTSHNMHWVKQTPGQGLEWIGYIYPGNGGTYYNQKFKGKATLTADTSSSTAYMQISSLTSEDSAVYFCARDYYGNSFVYWGQGTLVTVSA

SEQ ID NO: 506 - protein, 113 aa, Artificial Sequence
  243F6D2-VL
DVVMTQSPSSLTEKTGEKVSMSCKSSQSLLNSGNQKNYLTWYQQKPGQPPKLLIYWASTRESGVPDRFTGSGSGTDFTLTISSLQTEDLAVYYCQNNYRYPFTFGAGTKLELK

SEQ ID NO: 507 - protein, 118 aa, Artificial Sequence; identical to SEQ ID NO: 9
  250F4G1-VH

SEQ ID NO: 508 - protein, 113 aa, Artificial Sequence; identical to SEQ ID NO: 10
  250F4G1-VL

SEQ ID NO: 509 - protein, 118 aa, Artificial Sequence
  257F1E11-VH
QAYLQQSGAELVRSGASVKMSCKASGYTFTSHNIHWVKQTPRQGLEWIGYIYPGNGGTNYNQKFKGKATLTADTSSSTAYMQISSLTSEDSAVYFCTRDYYGNSFAYWGQGTLVTVSA

SEQ ID NO: 510 - protein, 113 aa, Artificial Sequence
  257F1E11-VL
DIVMTQSPSSLTEKAGERVSMSCKSSQSLFNSGNQKNYLTWYQQKPGQPPKLLIYWASTRESGVPDRFTGSGSGTDFTLTISSVQAEDLAIYYCQNDYWYPFTFGAGTKLELK

SEQ ID NO: 511 - protein, 118 aa, Artificial Sequence; identical to SEQ ID NO: 17
  257G7F7-VH

SEQ ID NO: 512 - protein, 113 aa, Artificial Sequence; identical to SEQ ID NO: 18
  257G7F7-VL

SEQ ID NO: 513 - protein, 118 aa, Artificial Sequence
  260F8A6-VH
QAYLQQSGAELVRSGASVKMSCRASGYTFTSHNMHWVKQTPGQGLEWIGYIYPGNGNTYYNQKFKGKATLTADTSSNTAYMQINSLTSEDSAVYFCVRDYYGNSFVYWGQGTLVTVSA

SEQ ID NO: 514 - protein, 113 aa, Artificial Sequence
  260F8A6-VL
DVVMTQSPSSLTEKTGEKVSMSCKSSQSLLNSGNQKNYLTWYQQKPGQPPKLLIYWASTRESGVPDRFIGSGSGTDFTLTISSLQTEDLAVYYCQNNYMYPFTFGAGTKLELK

SEQ ID NO: 515 - protein, 118 aa, Artificial Sequence; identical to SEQ ID NO: 281
  268D7H9-VH

SEQ ID NO: 516 - protein, 113 aa, Artificial Sequence
  268D7H9-VL
DIAMTQSPSSLTVTAGEKVTMNCKSSQSLLNSGNQKNYLTWYQQKPGQPPKLLIYWASTRESGVPDRFTGSGSGTDFTLTISSVQAEDLAIYYCQNDYYYPLTFGAGTTLELK

SEQ ID NO: 517 - protein, 118 aa, Artificial Sequence; identical to SEQ ID NO: 11
  271B1B6-VH

SEQ ID NO: 518 - protein, 113 aa, Artificial Sequence; identical to SEQ ID NO: 12
  271B1B6-VL

SEQ ID NO: 519 - protein, 118 aa, Artificial Sequence
  275H9A2-VH
QAYLQQSGAELVRSGASVKMSCRASGYSFTSHNMHWVKQTPGQGLEWIGYIYPGNGGSYYNQKFKGKAILTADTSSSTAYMQISSLTSEDSAVYFCTRDYYGNSFVYWGQGTLVTVSA

SEQ ID NO: 520 - protein, 113 aa, Artificial Sequence
  275H9A2-VL
DVVMTQSPSSLTEKTGEKVSMSCKSSQSLLNSGNQKNYLTWYQQKPGQPPKLLIYWASTRESGVPDRFTGSGSGTDFTLTISSLQTEDLAVYYCQNNFRYPFTFGAGTKLELK

SEQ ID NO: 521 - protein, 118 aa, Artificial Sequence; identical to SEQ ID NO: 41
  200A4H8-VH

SEQ ID NO: 522 - protein, 113 aa, Artificial Sequence; identical to SEQ ID NO: 42
  200A4H8-VL

SEQ ID NO: 523 - protein, 118 aa, Artificial Sequence; identical to SEQ ID NO: 41
  203A6D5-VH

SEQ ID NO: 524 - protein, 113 aa, Artificial Sequence; identical to SEQ ID NO: 42
  203A6D5-VL

SEQ ID NO: 525 - protein, 117 aa, Artificial Sequence
  248G8E8-VH
QVQLKESGPGLVAPSQSLSITCTVSGFSLTTYGVSWVRQPPGKGLEWLGVIWGDGSTNYHSTLISRLRISKDKSKSQVFLKLNSLQTDDTATYYCAKAGRGNALDYWGQGTSVTVSS

SEQ ID NO: 526 - protein, 113 aa, Artificial Sequence
  248G8E8-VL
DIVLTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSFPLTFGAGTKLELK

SEQ ID NO: 527 - protein, 118 aa, Artificial Sequence; identical to SEQ ID NO: 57
  391F1G2-VH

SEQ ID NO: 528 - protein, 113 aa, Artificial Sequence; identical to SEQ ID NO: 58
  391F1G2-VL

SEQ ID NO: 529 - protein, 118 aa, Artificial Sequence
  406F11G8-VH
DVQLVESGGGLVQPGGSRKLSCAASGFTFSSFGMHWVRQAPEKGLEWVAYISSGSSPIYYADTVKGRFTISRDNSKNTLFLQMTSLRSEDTAMYFCARIYYGNSFAYWGQGTLVTVSA

SEQ ID NO: 530 - protein, 113 aa, Artificial Sequence
  406F11G8-VL
DIVMTQSPSSLTVTAGEKVAMSCKSSQTLLNSGNQKNYLTWYQQKPGQPPKLLIYWASTRESGVPDRFTGSGSGTDFTLTISSVQAEDLAVYYCQNAYYYPLTFGSGTKLELK

SEQ ID NO: 531 - protein, 118 aa, Artificial Sequence; identical to SEQ ID NO: 53
  410A9A9-VH

SEQ ID NO: 532 - protein, 113 aa, Artificial Sequence; identical to SEQ ID NO: 54
  410A9A9-VL

SEQ ID NO: 533 - protein, 118 aa, Artificial Sequence; identical to SEQ ID NO: 49
  410D9G2-VH

SEQ ID NO: 534 - protein, 113 aa, Artificial Sequence; identical to SEQ ID NO: 50
  410D9G2-VL

SEQ ID NO: 535 - protein, 118 aa, Artificial Sequence
  416F12F3-VH
DVQLVESGGGLVQPGGSRKLSCAASGFTFSSFGMHWVRQAPEKGLEWVAYISSGSSTIYYAHSVKGRFTISRDNPKNTLFLQMTSLGSEDTAMYYCARFYYGNSFAYWGQGTLVTVSA

SEQ ID NO: 536 - protein, 113 aa, Artificial Sequence
  416F12F3-VL
DIVMTQSPSSLTVTAGEKVTLSCKSSQSLLNSGNQKNYLTWYQQKPGQPPKMLIYWASTRESGVPDRFTGSGSGTDFTLTISSVQAEDLAVYYCQNAYTYPLTFGAGTRLELK

SEQ ID NO: 537 - protein, 118 aa, Artificial Sequence; identical to SEQ ID NO: 535
  420H3H9-VH

SEQ ID NO: 538 - protein, 113 aa, Artificial Sequence
  420H3H9-VL
DIVMTQSPSSLTVTAGEKVTLSCKSSQSLLNSGNQKNYLTWYQQKPGQPPKMLIYWASTRESGVPDRFTGSGSGTDFTLTISSVQAEDLADYYCQNAYTYPLTFGAGTRLELK

SEQ ID NO: 539 - protein, 118 aa, Artificial Sequence
  411G12G1-VH
DVQLVESGGGLVQPGGSRKLSCAASGFTFSGFGMHWIRQAPEKGLEWVAYISSGSRPIYYADTVKGRFTISRDNPKNTLFLQMTSLRSEDTAMYFCARFYYGNSFDHWGQGTLVTVSA

SEQ ID NO: 540 - protein, 113 aa, Artificial Sequence
  411G12G1-VL
DIVMTQSPSFLTVTAGEKVTMSCKSSQSLLNSGNQKNYLTWYQQKPGQPPKLLIYWASTRESGVPDRFTGSGSGTDFTLTISSVQAEDLAVYYCQNDYSFPLTFGAGTKLELK

SEQ ID NO: 541 - protein, 118 aa, Artificial Sequence; identical to SEQ ID NO: 53
  429G4E9-VH

SEQ ID NO: 542 - protein, 113 aa, Artificial Sequence; identical to SEQ ID NO: 54
  429G4E9-VL

SEQ ID NO: 543 - protein, 118 aa, Artificial Sequence; identical to SEQ ID NO: 49
  391H11H3-VH

SEQ ID NO: 544 - protein, 113 aa, Artificial Sequence; identical to SEQ ID NO: 50
  391H11H3-VL

SEQ ID NO: 545 - protein, 118 aa, Artificial Sequence; identical to SEQ ID NO: 49
  395B3C11-VH

SEQ ID NO: 546 - protein, 113 aa, Artificial Sequence; identical to SEQ ID NO: 50
  395B3C11-VL

SEQ ID NO: 547 - protein, 118 aa, Artificial Sequence; identical to SEQ ID NO: 49
  406E1H7-VH

SEQ ID NO: 548 - protein, 113 aa, Artificial Sequence; identical to SEQ ID NO: 50
  406E1H7-VL

SEQ ID NO: 549 - protein, 118 aa, Artificial Sequence
  414H6G2-VH
DVQLVESGGGLVQPGGSRKLSCAASGFTFSGFGMHWIRQTAEKGLEWVAYISSGSRPIYYADTVQGRFTISRDNPKNTLFLQMTSLRSEDTAMYFCARFYYGNSFDHWGQGTLVTVSA

SEQ ID NO: 550 - protein, 113 aa, Artificial Sequence; identical to SEQ ID NO: 50
  414H6G2-VL

SEQ ID NO: 551 - protein, 118 aa, Artificial Sequence; identical to SEQ ID NO: 549
  420G10G3-VH

SEQ ID NO: 552 - protein, 113 aa, Artificial Sequence; identical to SEQ ID NO: 50
  420G10G3-VL

SEQ ID NO: 553 - protein, 118 aa, Artificial Sequence; identical to SEQ ID NO: 49
  422E8F9-VH

SEQ ID NO: 554 - protein, 113 aa, Artificial Sequence; identical to SEQ ID NO: 50
  422E8F9-VL

SEQ ID NO: 555 - protein, 118 aa, Artificial Sequence
  422F4B6-VH
DVQLVESGGGLVQPGGSRKLSCAASGFSFSSFGMHWVRQAPEKGLEWVAYISSGSSPIYYADTVKGRFIISRDNPKNTLFLQMTSLRSEDTAMYFCARIYYGNSFAYWGQGTLVTVSA

SEQ ID NO: 556 - protein, 113 aa, Artificial Sequence
  422F4B6-VL
DIVMTQSPSSLTVTAGEKVTMSCKSSQTLLNSGNQKNYLTWYQQKPGQPPKLLIYWASTRESGVPDRFTGSGSGTDFTLTISSVQAEDLAVYYCQNAYSYPLTFGSGTKLELK

SEQ ID NO: 557 - protein, 118 aa, Artificial Sequence; identical to SEQ ID NO: 49
  425B3D5-VH

SEQ ID NO: 558 - protein, 113 aa, Artificial Sequence; identical to SEQ ID NO: 50
  425B3D5-VL

SEQ ID NO: 559 - protein, 118 aa, Artificial Sequence; identical to SEQ ID NO: 49
  425C6D3-VH

SEQ ID NO: 560 - protein, 113 aa, Artificial Sequence; identical to SEQ ID NO: 50
  425C6D3-VL

SEQ ID NO: 561 - protein, 118 aa, Artificial Sequence; identical to SEQ ID NO: 49
  426H6E11-VH

SEQ ID NO: 562 - protein, 113 aa, Artificial Sequence
  426H6E11-VL
DIVMTQFPSFLTVTAGEKVTMSCKSSQTLLNSGNQKNYLTWYQQKPGQPPKLLIYWASTRESGVPDRFTGSGSGTDFTLTISSVQAEDLALYYCQNAYSFPLTFGAGTNLELK

SEQ ID NO: 563 - protein, 119 aa, Artificial Sequence; identical to SEQ ID NO: 67
  59B6C9E8-VH

SEQ ID NO: 564 - protein, 113 aa, Artificial Sequence; identical to SEQ ID NO: 68
  59B6C9E8-VL

SEQ ID NO: 565 - protein, 118 aa, Artificial Sequence
  186F7E10-VH
EVMLVESGGGLVKPGGSLKLSCAASRFTLNSYAMSWIRQTPEKKLEWVATITSGVSHTYYFDSVKGRFTISRDTAKNTLNLQMNSLRSEDTAVYYCARLYYGNSLDYWGQGTSVTVSS

SEQ ID NO: 566 - protein, 113 aa, Artificial Sequence
  186F7E10-VL
DIVMTQSPSSLTVTAGEKVTVSCKSSQSLLNSGNQKNYLTWYQQKPGQPPKLLIYWASTRESGVPDRFTGSGSGTDFTLTISSVQSEDLAVYYCQNNYIYPLTFGAGTTLELK

SEQ ID NO: 567 - protein, 118 aa, Artificial Sequence
  186G12H3-VH
EVMLVESGGGLVKPGGSLKLSCAASRFTLSSYAMSWVRQTPEKRLEWVATISSGGSYTYYFDSVKGRFTISRDTAKNTLNLQMSSLRSEDTAMYYCARLYYGNALDYWGQGTSVTVSS

SEQ ID NO: 568 - protein, 113 aa, Artificial Sequence
  186G12H3-VL
DIVMTQSPSSLTVTAGEKVTVSCKSSQSLLNSGNQKNYLTWYQQKPGQPPKLLIYWASTRESGVPDRFTGSGSGTDFTLTISSVQAEDLAVYYCQNNYIYPLTFGAGTTLELK

SEQ ID NO: 569 - protein, 118 aa, Artificial Sequence
  194A2F7-VH
QIQLVQSGPELKKPGETVKISCKASGYTFTDYLIHWVKQAPGKGLKWMGWINTETGEPTYADDFKGRFALSLETSASTACLQINNLKNEDTATYFCARIYYGNSFDYWGQGTTLTVSS

SEQ ID NO: 570 - protein, 113 aa, Artificial Sequence
  194A2F7-VL
DIVMTQSPSSLPVTAGEKVTMTCKSSQNLLNSGNQKSYLTWYQQKPGQPPKLLIYWASTRETGVPDRFTGSGSGTDFTLTISSVQAEDLAVYYCQNAYRFPFTFGAGTRLELK

SEQ ID NO: 571 - protein, 115 aa, Artificial Sequence
  217D9G2-VH
QAYLQQSGAELVRSGASVKMSCKASGFTFTSYNIHWVKQTPGQGLEWIGYISPGNGGSNYNLNFKDKATLTAATSSTTAYMQISSLTSEDSAVYFCATGRGFAYWGQGTLVTVSA

SEQ ID NO: 572 - protein, 113 aa, Artificial Sequence
  217D9G2-VL
DIVMTQSPSSLTVTPGEKVTMSCRSSQSLFNSGNQKNYLIWYQQKPGQPPKLLIYRASTRDSGVPDRFTGSGSGTDFTLTISNVQAEDLAVYYCQNDYSYPLTFGAGTKLELK

SEQ ID NO: 573 - protein, 115 aa, Artificial Sequence
  219F9B8-VH
QAYLQQSGAELVRSGASVRMSCKASGYTFTSYNMHWVKQTPGQGLEWIGYIYPGNGHTNYNQKFKGKATLTADTSSSTAYMQISSLTSEDSAVYFCATGRGFAYWGQGTLVTVSA

SEQ ID NO: 574 - protein, 113 aa, Artificial Sequence
  219F9B8-VL
DIVMTQSPSSLTVTAGEKVTMSCKSSQSLLNSGNQKNYLTWYQQKPGQPPKLLIYRASTRESGVPDRFTGSGSGTDFTLTISSVQAEDLAVYYCQNDYSYPLTFGVGTKLELK

SEQ ID NO: 575 - protein, 118 aa, Artificial Sequence
  231C11E9-VH
EVMLVESGGGLVKPGGSLKLSCAASGFTFNNYVMCWVRQTPEKRLEWVATISSGNFYTYYPDSVKGRFTISRDNAKNTLYLQMSSLRSEDTAIYYCASLGRGNALDNWGQGTSVTVSS

SEQ ID NO: 576 - protein, 113 aa, Artificial Sequence
  231C11E9-VL
DIVMTQSPASLTVTAKEKVTMSCRSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 577 - protein, 118 aa, Artificial Sequence
  234C9G5-VH
QAYLQQSGAELVRSGASVKMSCKASGYAFTSHNMHWVKQTPGQGLEWIGYISPGNGYTNYNQKFRGKATLTADTSSSTAYMQIGSLTSEDSAVYFCTRDYYGNSFAYWGQGTLVTVSA

SEQ ID NO: 578 - protein, 113 aa, Artificial Sequence; identical to SEQ ID NO: 18
  234C9G5-VL

SEQ ID NO: 579 - protein, 118 aa, Artificial Sequence; identical to SEQ ID NO: 269
  234E1F12-VH

SEQ ID NO: 580 - protein, 113 aa, Artificial Sequence; identical to SEQ ID NO: 270
  234E1F12-VL

SEQ ID NO: 581 - protein, 118 aa, Artificial Sequence
  240A8E7-VH
QAYLQQSGAELVRSGASVKMSCKASGYTFTNYNIHWVKQTPGQGLEWIGYIYPGNGDNYYNQKFKGKATLTADTSSSTAYMQISSLTSEDSAVYFCARDYYGNSFAYWGQGTLVTVSA

SEQ ID NO: 582 - protein, 113 aa, Artificial Sequence
  240A8E7-VL
DVVMTQSPSSLTVTAGEKVTMNCKSSQSLLNSGNQKNYLTWYQQKPGQPPKMLIYWASTRESGVPDRFTGSGSGTDFTLTISSVQAEDLAIYYCQNDYYYPFTFGAGTKLELK

SEQ ID NO: 583 - protein, 118 aa, Artificial Sequence; identical to SEQ ID NO: 285
  242F5H2-VH

SEQ ID NO: 584 - protein, 113 aa, Artificial Sequence; identical to SEQ ID NO: 286
  242F5H2-VL

SEQ ID NO: 585 - protein, 118 aa, Artificial Sequence; identical to SEQ ID NO: 279
  244A1B8-VH

SEQ ID NO: 586 - protein, 113 aa, Artificial Sequence; identical to SEQ ID NO: 280
  244A1B8-VL

SEQ ID NO: 587 - protein, 120 aa, Artificial Sequence
  252C10F6-VH
QVHLKQSGRGLVQPSQSLSITCTVSGFSLPNYGVHWVRQPPGKGLEWLGVIWSGGNTDYNTVFKARLSITKDNSKSQVFFKMNSLQADDTAIYYCARNLYGNYDYAMDYWGQGTSVTVSS

SEQ ID NO: 588 - protein, 107 aa, Artificial Sequence
  252C10F6-VL
DIVMTQSPATLSVTPGDRVSLSCRASQSISDYLHWYQQKSHESPRLLIKYASQSISGIPSRFSGSGSGSEFTLSINSVEPEDVGVYYCQNGHSFPFTFGSGTKLEIK

SEQ ID NO: 589 - protein, 118 aa, Artificial Sequence; identical to SEQ ID NO: 577
  256C3D3-VH

SEQ ID NO: 590 - protein, 113 aa, Artificial Sequence; identical to SEQ ID NO: 18
  256C3D3-VL

SEQ ID NO: 591 - protein, 118 aa, Artificial Sequence
  258D11C4-VH
QAYLQQSGAELVRSGASVKMSCKASGYTFSSHNMHWVKQTPGQGLEWIGYIYPGNGGTNYNQKFKGKATLTADTSSSTAYMQISSLTSEDSAVYFCTRDYYGNSFAYWGQGTLVTVSA

SEQ ID NO: 592 - protein, 113 aa, Artificial Sequence
  258D11C4-VL
DIVMTQSPSSLTEKAGERVSMSCKSSQSLFNSGNQKNYLTWYQQKPGQPPKLLIYWASTRQSGVPDRFTGSGSGTDFTLTISSVQAEDLAVYYCQNDYWFPFTFGAGTKLELK

SEQ ID NO: 593 - protein, 115 aa, Artificial Sequence
  259B4D4-VH
EIQLQQSGPELMKPGASVRISCKASGYSFTSYYMHWMKQSHVKSLEWIGYIDPFNGNTRYNQKFKDKATLTVDKSSTTAYMHLSSLTSEDSAVYFCASLRFFAYWGQGTLVTVSA

SEQ ID NO: 594 - protein, 113 aa, Artificial Sequence
  259B4D4-VL
DIVMTQSPSSLTVTAGEKVTMSCNSSQSLLNSGNQKNYLTWYQQKPGQPPKLLIYWASSRESGVPDRFTGSGSGTDFTLTISTVQAEDLAVYYCQNDYSFPLTFGAGTRLELK

SEQ ID NO: 595 - protein, 118 aa, Artificial Sequence; identical to SEQ ID NO: 287
  259C6F7-VH

SEQ ID NO: 596 - protein, 113 aa, Artificial Sequence; identical to SEQ ID NO: 288
  259C6F7-VL

SEQ ID NO: 597 - protein, 118 aa, Artificial Sequence
  262H9H6-VH
QAYLQQSGAELVRSGASVKMSCKASGYTFTSHNMHWVKQTPGQGLEWIGYISPGNGYTNYNQKFRGKATLTADTSSSTAYMQISSLTSEDSAVYFCTRDYYGNSFTYWGQGTLVTVSA

SEQ ID NO: 598 - protein, 113 aa, Artificial Sequence
  262H9H6-VL
DIVMTQSPSSLTEKAGERVSMSCKSSQSLFNSGNQKNYLTWYQQKPGQPPKLLIYWASTRESGVPDRFTGSGSGTEFTLTISSVQAEDLAVYYCQNNYWFPFTFGAGTKLELK

SEQ ID NO: 599 - protein, 115 aa, Artificial Sequence
  263E9F3-VH
EIQVQQSGPELMKPGASVKISCRSSGYSFTSYYIHWVKQSRGKSLEWIGYIDPFSGGTRYNQKFEGKATLTVDKSSTTAYMHLSSLTSEDSAVYYCASLRFFAYWGQGTLVTVSA

SEQ ID NO: 600 - protein, 113 aa, Artificial Sequence
  263E9F3-VL
DIVMTQSPSSLTVTAGEKVTMTCKSSQSLLNSGNQENYLTWYQQKPGQPPELLISRASTRQSGVPDRFTGSGSGTDFTLTISSVQTEDLAVYYCQNDYSYPLTFGAGTKLELK

SEQ ID NO: 601 - protein, 117 aa, Artificial Sequence
  266B11F7-VH
QVQMKESGPGLVAPSQSLSITCTVSGFSLTTYGVTWVRQPPGKGLEWLGVIWGDGSTNYHSALTSRLRISKDKSKSQVFLKLSSLQTDDTATYYCAKPGRGNALDYWGQGTSVTVSS

SEQ ID NO: 602 - protein, 113 aa, Artificial Sequence
  266B11F7-VL
DIVMTQSPSSLTVTAGEKVTMRCKSSQSLLNSGNQKNYLTWYQQKPGQPPKLLVYWASTRESGVPDRFTGSGSGTDFTLTVSSVQAEDLAVYYCQNDYIFPLTFGAGTKLELK

SEQ ID NO: 603 - protein, 117 aa, Artificial Sequence
  267B2C5-VH
QVQLKESGPGLVAPSQSLAITCTVSGFSLTTYGVSWVRQPPGKGLEWLGVIWGDGSTHYHSALISRLSIRKDNSKSQVFLKVNSLQTDDTATYYCGKPGRGNAMDYWGQGTSVTVSS

SEQ ID NO: 604 - protein, 113 aa, Artificial Sequence
  267B2C5-VL
DIVMTQSPSSLTVTAGEKVTMSCKSSQSLLNSGNQKNYLTWYQQKPGQSPKLLIYWASTRESGVPDRFTGSGSGTDFTLTISSVQAEDLAVYYCQNDYIYPLTFGGGTTLELK

SEQ ID NO: 605 - protein, 118 aa, Artificial Sequence; identical to SEQ ID NO: 597
  267H5F12-VH

SEQ ID NO: 606 - protein, 113 aa, Artificial Sequence; identical to SEQ ID NO: 598
  267H5F12-VL

SEQ ID NO: 607 - protein, 117 aa, Artificial Sequence; identical to SEQ ID NO: 271
  273F3D4-VH

SEQ ID NO: 608 - protein, 113 aa, Artificial Sequence; identical to SEQ ID NO: 272
  273F3D4-VL

SEQ ID NO: 609 - protein, 118 aa, Artificial Sequence
  275B2G2-VH
EVMLVESGGGLVKPGGSLKLSCAASGFTFRDYTMSWVRQTPEKRLEWVATSIIGGTYTYYPDSVKGRFTISRDNVKNTLYLQMSSLRSEDTAMYYCSRLGRGNAMDYWGQGTSVTVSS

SEQ ID NO: 610 - protein, 113 aa, Artificial Sequence
  275B2G2-VL
DIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPFTFGSGTKLEIK

SEQ ID NO: 611 - protein, 118 aa, Artificial Sequence
  277F1F8-VH
QAYLQQSGPELVRSGASVKMSCKASGYTFTSHNMHWVKQTPGQGLEWIGYINPGNGGNNYNQKFKGKATLTADTSSSTAYMQISSLTSEDSAVYFCARDYYGNSFAFWGQGTLVTVSA

SEQ ID NO: 612 - protein, 113 aa, Artificial Sequence
  277F1F8-VL
DIVMTQSPSSLTETAGEKVSMSCKSSQSLLNSGNQKNYLTWYQQKPGQPPKLLIYWASTRESGVPDRFTGSGSGTDFTLTISSVQAEDLAVYYCQNDYRFPFTFGAGTKLELK

SEQ ID NO: 613 - protein, 117 aa, Artificial Sequence
  286C7F11-VH
QVQLKESGPGLVAPSQSLSITCTVSGFSLTDYGVSWIRQPPGKGLEWLGVIWNRGNTYYNSALKSRLSISKDNSKSQVFLRMNSLQTDDTAMYYCAKHDFLRFLDYWGQGTTLTVSS

SEQ ID NO: 614 - protein, 113 aa, Artificial Sequence
  286C7F11-VL
DVVMTQSPSSLTVTAGEKVTMSCKSSQSLLNSGNQKNYLTWYQQKPGQPPKILIYWASTRESGVPDRFTGSGSGTDFSLTITSVQAEDLAVYYCLNDYYYPLTFGAGTKLELK

SEQ ID NO: 615 - protein, 117 aa, Artificial Sequence
  292D9C7-VH
QVQLKESGPGLVAPSQSLSITCTVSGFSLTDYGVSWIRQPPGKGLEWLGVIWGGGNAYYNSALKSRLSISKDNSKSQVFLKMNSLRTDDTAMYYCAKNGLLRYLDYWGQGSTLTVSS

SEQ ID NO: 616 - protein, 113 aa, Artificial Sequence
  292D9C7-VL
DTVMTQSPSSLTVTAGEKVTMSCKSSQSLLNSGNQKNYLTWYQQKPGQPPKLLIYWASTRESGVPDRFTGSGSGRDFTLTISSVQVEDLAIYYCQNDYYYPLTFGAGTKVELK

SEQ ID NO: 617 - protein, 118 aa, Artificial Sequence
  392A11C8-VH
DVQLVESGGGLVQPGGSRKLSCAASGFTFSGFGMHWIRQTPEKGLEWVAYISSGSRPIYYADTVKGRFTISRDNPKNTLFLQMTSLRSEDTAMYFCARFYYGNSFDHWGQGTLVTVSA

SEQ ID NO: 618 - protein, 113 aa, Artificial Sequence
  392A11C8-VL
DIVMTQSPSFLTVTAGEKVTMSCRSSQSLLNSGNQKNYLTWYQQKPGQPPKLLIYWASTRESGVPDRFTGSGSGTDFTLTISSVQAEDLALYYCQNAYSFPLTFGAGTKLELK

SEQ ID NO: 619 - protein, 112 aa, Artificial Sequence
  392C2F10-VH
EVQLQQSGPELVKPGASMKISCKASGYSFTGYTMNWVKQSLGKNLEWIGLINPFNGGTTYNQKFKGKATLTVDKSSSTAYMELLSLTSDDSAVYYCTRGDYWGQGTTLTVSS

SEQ ID NO: 620 - protein, 112 aa, Artificial Sequence
  392C2F10-VL
DIVMTQSPSSLTVTAGEKVTMSCKSSQSLLNSGNQKNYLTWYQQKPGQPPKLLIYWASTRESGVPDRFAGSGSGTDFTLTISSVQAEDLAVYYCQSDYSYPTFGAGTKLELK

SEQ ID NO: 621 - protein, 118 aa, Artificial Sequence
  394C2G5-VH
DVQLVESGGGLVQPGGSRKLSCAASGFTFSGFGMHWIRQTPEKGLEWVAYVSSGSRPIYYADTVKGRFTISRDNPKNTLFLQMTSLRSEDTAMYFCARFYYGNSFDHWGQGTLVTVSA

SEQ ID NO: 622 - protein, 113 aa, Artificial Sequence
  394C2G5-VL
DIVMTQSPSFLTVTAGEKVTMSCKSSQSLLNSGNQKNYLTWYQQKPGQPPKLLIYWASTRESGVPDRFTGSGSGTDFTLTINNVQAEDLALYYCQNAYSFPLTFGAGTKLELT

SEQ ID NO: 623 - protein, 118 aa, Artificial Sequence
  405G8F11-VH
DVQLVESGGGLVQPGGSRKLSCVTSGFTFSSFGMHWVRQAPEKGLEWVAYISSGSSPIYYADTVKGRFTISRDNPKNTLFLQMSSLRSEDTAMYFCARFYYGNSFAYWGQGTLVTVSA

SEQ ID NO: 624 - protein, 113 aa, Artificial Sequence
  405G8F11-VL
DIVMTQSPSSLTVTAGEKVTMNCKSSQSLLNSGNQKNYLTWYQQKLGQPPKLLMYWASTRESGVPDRFTGSGSGTDFTLTISSVQAEDLAVYFCQSAFSYPLTFGAGTKLELK

SEQ ID NO: 625 - protein, 120 aa, Artificial Sequence
  406G3C4-VH
EIQLQQSGPELMKPGASVRISCKASGYSFISYYIYWVKQSHGKGLEWIGYIDPFNGNTNYNQKFKGKATLTVDRSSSTAYIHLNSLTSEDSAVYYCAIVNGYGRGAMDYWGQGTSVTVSS

SEQ ID NO: 626 - protein, 106 aa, Artificial Sequence
  406G3C4-VL
QIVLTQSPAIMSASPGEKVTMTCSASSSISYMHWYQQKSGTSPKRWIYDTSKLASGVPARFSGSGSGTSYSLTISSMEAEDAATYYCQQWSSNPLTFGDGTKLELK

SEQ ID NO: 627 - protein, 118 aa, Artificial Sequence; identical to SEQ ID NO: 617
  407A8G10-VH

SEQ ID NO: 628 - protein, 113 aa, Artificial Sequence
  407A8G10-VL
DIVMTQSPSFLTVTAGEKVTMSCRSSQSLLNSGNQRNYLTWYQQKPGQPPKLLIYWASTRESGVPDRFTGSGSGTDFALTISSVQAEDLALYYCQNAYSFPLTFGAGTKLELK

SEQ ID NO: 629 - protein, 118 aa, Artificial Sequence
  407E11H8-VH
DVQLVESGGGLVQPGGSRKLSCAASGFTFSDFGMHWIRQTPEKGLEWVAYISSGSRPIYYADTVKGRFTISRDNPKNTLFLQMTSLRSEDTAMYFCVRFYFGNSFDHWGQGTLVTVSA

SEQ ID NO: 630 - protein, 113 aa, Artificial Sequence
  407E11H8-VL
DIVMTQSPSFLTVTAGEKVTMTCRSSQNLLNSGNLKNYLTWYQQKPGQPPKLLISWASTRESGVPDRFTGSGSGTDFTLTISSVQPEDLALYYCQNAYSFPLTFGAGTKLELK

SEQ ID NO: 631 - protein, 118 aa, Artificial Sequence
  407H12E6-VH
DVQLVESGGGLVQPGGSRKLSCAASGFTVSSFGMHWVRQAPEKGLEWVAYISSGSSPIYYADTVKGRFTISRDNPKNTLFLQMTSLRSEDTAIYFCARFYYGNSFDHWGQGTLVTVSA

SEQ ID NO: 632 - protein, 113 aa, Artificial Sequence
  407H12E6-VL
DIVMTQSPSSLTVTTGEKVTMSCKSSQSLLNSGNQKNYLTWYQQKPGQSPKLLIYWASTRESGVPDRFTGSGSGTDFTLTISSVQTEDLAVYFCQNNYFFPLTFGAGTKLELK

SEQ ID NO: 633 - protein, 118 aa, Artificial Sequence
  409D1A7-VH
DVQLVESGGGLVQPGGSRKLSCAASGFTFSGFGMHWIRQTPEKGLEWVAYISSGSRPIYYADTVKGRFTISRDNPKNTLFLHMTSLRSEDTAMYFCARFYYGNSFDHWGQGTLVTVSA

SEQ ID NO: 634 - protein, 113 aa, Artificial Sequence
  409D1A7-VL
DIVMTQSPSFLTVTAGEKVTMNCKSSQSLLNSGNQRNYLTWYQQKPGQPPKLLIYWASTRESGVPDRFTGSGSGTDFTLTISSVQAEDLALYYCQNAYSFPLTFGAGTKLELN

SEQ ID NO: 635 - protein, 118 aa, Artificial Sequence
  409G10G6-VH
DVQLVESGGGLVQPGGSRKLSCAASGFTFSGFGMHWIRQTPEKGLEWVAYISSDSRPIYYADTVKGRFTISRDNPKNTLFLQMTSLRSEDTAMYFCGRFYYGNSFDHWGQGTLVTVSA

SEQ ID NO: 636 - protein, 113 aa, Artificial Sequence
  409G10G6-VL
DIVMTQSPSFLTVTAGEKVTLSCRSSQSLLNSGNQRNYLTWYQQKPGQPPKLLIYWASTRESGVPDRFTGSGSGTDFTLTISSVQAEDRALYYCQNAYSFPLTFGTGTKLELR

SEQ ID NO: 637 - protein, 118 aa, Artificial Sequence; identical to SEQ ID NO: 629
  411A6E3-VH

SEQ ID NO: 638 - protein, 113 aa, Artificial Sequence; identical to SEQ ID NO: 630
  411A6E3-VL

SEQ ID NO: 639 - protein, 118 aa, Artificial Sequence
  411B4G4-VH
DVQLVESGGGLVQPGGSRKLSCAASGFTFSGFGLHWIRQTPEKGLEWVAYISSGSRPIYYADTVKGRFTISRDNPKNTLFLQMTSLRSEDTAMYFCARFYYGNSFDHWGQGTLVTVSA

SEQ ID NO: 640 - protein, 113 aa, Artificial Sequence
  411B4G4-VL
DIVMTQSPSFLTVTAGEKVTMSCRSSQSLLNSGNQRNYLTWYQQKPGQPPKLLIYWASTRESGVPDRFTGSGSGTDFTLTISSVQAEDLALYYCQNAYSFPLTFGAGTKLELK

SEQ ID NO: 641 - protein, 118 aa, Artificial Sequence; identical to SEQ ID NO: 617
  411G3E10-VH

SEQ ID NO: 642 - protein, 113 aa, Artificial Sequence
  411G3E10-VL
DIVMTQSPSFLTVTAGEKVTMNCRSSQSLLNSGNQKNYLTWYQQKPGQPPKLLIYWASTRESGVPDRFTGSGSGTDFTLTISSVQAEDLALYYCQNAYSFPLTFGAGTKLELK

SEQ ID NO: 643 - protein, 118 aa, Artificial Sequence
  413B1C9-VH
DVQLVESGGGLVQPGGSRKLSCAASGFTFSSFGMHWVRQAPEKGLEWVAYISSGSSPIYYADTVKGRFTISRDNPKNTLFLQMTSLRSEDTAMYFCARFYYGNSFDHWGQGTLVTVSA

SEQ ID NO: 644 - protein, 113 aa, Artificial Sequence
  413B1C9-VL
DIVMTQSPSSLTVTTGEKVSMSCKSSQSLFNRGNQKSYLTWYQQKPGQPPKLLIYWASTRESGVPDRFTGSGSGTDFTLTISSVQAEDLAVYYCQNNYIYPLTFGAGTKLELK

SEQ ID NO: 645 - protein, 118 aa, Artificial Sequence
  413C12F8-VH
DVQLVESGGGLVQPGGSRKLSCAASGFTFSGFGVHWIRQTPEKGLEWVAYIGSGSRPIYYADTVKGRFTISRDNPKNTLFLQMTSLRSEDTAMYFCARFYYGNSFDHWGQGTLVTVSA

SEQ ID NO: 646 - protein, 113 aa, Artificial Sequence
  413C12F8-VL
DIVMTQSPSFLTVTAGEKVTMNCRSSQSLLNSGNQKNYLTWYQQRPGQPPKLLIYWASTRESGVPDRFTGSGSGTDFTLTISSVQAEDLALYYCQNAYSFPLTFGAGTKLELK

SEQ ID NO: 647 - protein, 112 aa, Artificial Sequence; identical to SEQ ID NO: 619
  413H4G12-VH

SEQ ID NO: 648 - protein, 112 aa, Artificial Sequence; identical to SEQ ID NO: 620
  413H4G12-VL

SEQ ID NO: 649 - protein, 120 aa, Artificial Sequence
  418B11D3-VH
EIQLQQSGPELMKPGASVRISCKASGYSFISYYMYWVKQSHGKGLEWIGYIDPFNGNTNYNQKFKGKATLTVDRSSSTAYIHLSSLTSEDSAVYYCAIVNGYGRGAMDYWGQGTSVTVSS

SEQ ID NO: 650 - protein, 106 aa, Artificial Sequence; identical to SEQ ID NO: 626
  418B11D3-VL

SEQ ID NO: 651 - protein, 118 aa, Artificial Sequence
  418B8B10-VH
DVQLVESGGGLVQPGGSRKLSCAASGFTFSSFGMHWVRQAPEKGLEWVAYISSGSSPIYYTDTVKGRFTISRDNPKNTLFLQMTSLRSEDTAMYFCARFYYGNSFDHWGQGTLVTVSA

SEQ ID NO: 652 - protein, 113 aa, Artificial Sequence
  418B8B10-VL
DIVMTQSPSSLTVTAGEKVSMSCKSSQSLFNRGNQKSYLTWYQQRPGQPPKLLIYWASTRESGVPDRFTGSGSGTDFTLTISSVQAEDLAVYYCQNNYIYPLTFGAGTKLELK

SEQ ID NO: 653 - protein, 118 aa, Artificial Sequence; identical to SEQ ID NO: 617
  419A10D4-VH

SEQ ID NO: 654 - protein, 113 aa, Artificial Sequence
  419A10D4-VL
DIVMTQSPSFLTVTAGEKVTMSCKSSQSLLNSGNQRNYLTWYQQKPGQPPKLLIYWASTRESGVPDRFTGSGSGTDFTLTVSSVQAEDLALYYCQNAYSFPLTFGAGTKLELK

SEQ ID NO: 655 - protein, 118 aa, Artificial Sequence; identical to SEQ ID NO: 635
  419A5F3-VH

SEQ ID NO: 656 - protein, 113 aa, Artificial Sequence; identical to SEQ ID NO: 636
  419A5F3-VL

SEQ ID NO: 657 - protein, 118 aa, Artificial Sequence
  420D5H5-VH
DVQLVESGGGLVQPGGSRKLSCAASGFTLSGFGMHWIRQTPEKGLEWVAYISSGSRPIYYVDTVEGRFTISRDNPKNTLFLQMTSLRSEDTAMYFCARFYYGNSFDHWGQGTLVTVSS

SEQ ID NO: 658 - protein, 113 aa, Artificial Sequence
  420D5H5-VL
DIVMTQSPSFLTVTAGEKVTMSCKSSQSLLNSGNQKNYLTWYQQKPGQPPKLLIYWASTRESGVPDRFTGSGSGTDFTLTIRGVQAEDLALYYCQNAYSFPLTFGAGTKLELK

SEQ ID NO: 659 - protein, 118 aa, Artificial Sequence
  420F12G8-VH
DVQLVESGGGLVQPGGSRKLSCAASGFAFSGFGMHWIRQTPEKGLEWVAYISSGSRPIYYADTVKGRFTISRDNPKNTLFLQMTSLRSEDTAMYFCVRFYYGNSFDHWGQGTLVTVSA

SEQ ID NO: 660 - protein, 113 aa, Artificial Sequence
  420F12G8-VL
DIVMTQSPSFLTVTAGEKVTMTCRSSQNLLNSGNQKNYLTWYQQKPGQPPKLLISWASTRESGVPDRFTGSGSGTDFTLTISSVQPEDLALYYCQNAYSFPFTFGAGTKLELK

SEQ ID NO: 661 - protein, 118 aa, Artificial Sequence
  420H7E6-VH
DVQLVESGGGLVQPGGSRKLSCVTSGFTFSSFGMHWIRQAPEKGLEWVAFISGGGSPIFYADSVKGRFTVSRDNPKNTLFLQMTGLRSEDTAMYFCARFYFGNSFAYWGQGTLVTVSA

SEQ ID NO: 662 - protein, 113 aa, Artificial Sequence
  420H7E6-VL
DIVMAQSPSSLTVTAGEKVTMNCRSSQSLFNSGNQKNYLTWYQQKPGQPPKLLIYWASTRESGVPVRFTGSGSGTDFTLTISSVQAEDLAVYYCQTGFSYPLTFGPGTKLELK

SEQ ID NO: 663 - protein, 118 aa, Artificial Sequence
  421H4G3-VH
DVQLVESGGGLVQPGGSRKLSCAASGFSFSGFGLHWIRQTPEKGLEWVAYISSGSRPIYYADTVKGRFTISRDNPKNTLFLQMTSLRSEDTAMYFCARFYFGNSFDHWGQGTLVTVST

SEQ ID NO: 664 - protein, 113 aa, Artificial Sequence
  421H4G3-VL
DIVMTQSPSFLTVTAGEKVTMSCRSSQSLLNSGNQRNYLTWYQQKPGQPPKLLIYWASTRESGVPDRFTGSGSGTDFTLTINSVQAEDLALYYCQNAYSFPLTFGAGTKLELK

SEQ ID NO: 665 - protein, 118 aa, Artificial Sequence
  423B2B5-VH
DVQLVESGGGLVQPGGSRKLSCAASGFTFSSFGMHWVRQAPEKGLEWVAYISSGSSPIYYSDTVKGRFTISRDNPKNTLFLQMSSLRSEDTAMYFCARIYYGNSFDHWGQGTLVTVSA

SEQ ID NO: 666 - protein, 113 aa, Artificial Sequence
  423B2B5-VL
DIVMTQSPSSLTVTAGEKVTMNCKSSQSLLNSGNQKNYLTWYQQKPGQPPKLLIYWASTRESGVPDRFTGSGSGTDFTLTISSVQAEDLAVYYCQNDYSYPLTFGAGTKLELK

SEQ ID NO: 667 - protein, 118 aa, Artificial Sequence
  423C10E1-VH
DVQLVESGGGLVQPGGSRKLSCVTSGFTFSSFGMHWVRQAPEKGLEWVAFISGGGSPIFYADSVKGRFTVSRDNPKNTLFLQMTGLRSEDTAMYFCARFYFGNSFAYWGQGTLVTVSA

SEQ ID NO: 668 - protein, 113 aa, Artificial Sequence
  423C10E1-VL
DIVMTQSPSSLTVTAGEKVTMNCRSSQSLFNSGNQKNYLTWYQQKPGQSPKLLIYWASTRESGVPVRFTGSGSGTDFTLTISSVQAEDLAVYYCQTSFNYPLTFGPGTKLELK

SEQ ID NO: 669 - protein, 115 aa, Artificial Sequence
  424G9G3-VH
QVQLQQSGPEVVRPGASVKMSCKGSGYTLNNFWMHWVKQRPGQGLEWIGMIDTSNGETRLNQIFKDKATLTVDKSSKTAYMQLSSLTSEDSAVYYCAPYGNFADWGQGTTLTVSS

SEQ ID NO: 670 - protein, 112 aa, Artificial Sequence
  424G9G3-VL
DVLLTQTPLSLPVSLGDQASISCRSSQSIVYGNGNTYLEWYLQKPGQSPKLLIYKVSSRFSGVPDRFSGSGSGTDFTLKITKVEAEDLGVYYCFQGSHVPFTFGSGTKLEIK

SEQ ID NO: 671 - protein, 118 aa, Artificial Sequence; identical to SEQ ID NO: 617
  426D9F6-VH

SEQ ID NO: 672 - protein, 113 aa, Artificial Sequence; identical to SEQ ID NO: 654
  426D9F6-VL

SEQ ID NO: 673 - protein, 121 aa, Artificial Sequence
  427C7H2-VH
QVQLQQPGSELVRPGASVKLSCKASGYTFTSYWMHWVKQRPGQGLEWIGNIYPGSGSTNYDEKFKSKATLTVDTSSSTAYMQLSSLTSEDSAVYYCTRRITTATRDYFDYWGQGTTLTVSS

SEQ ID NO: 674 - protein, 108 aa, Artificial Sequence
  427C7H2-VL
EIVLTQSPALMAASPGEKVTITCSVSSSISSSNLHWYQQKSETSPKPWIYGTSNLASGVPVRFSGSGSGTSYSLTISSMEAEDAATYYCQQWSSYPLTFGGGTKLEIK

SEQ ID NO: 675 - protein, 116 aa, Artificial Sequence
  430A11H9-VH
DVKLVESGGGLVKPGGSLKLSCAASGFTFSSYTMSWVRQTPEKRLEWVATISSGGSYTYYPDSVKGRFTISRDNAKNTLYLQMSSLKSEDTAMYYCTRDPGYFAYWGQGTLVTVSA

SEQ ID NO: 676 - protein, 107 aa, Artificial Sequence
  430A11H9-VL
DIQMTQSPASLSASVGETVTITCRASENIYSYLAWYQQKQGKSPQLLVYNAKTLAEGVPSRFSGSGSGTQFSLKINSLQPEDFGSYYCQHHYGTPYTFGGGTKLEIK

SEQ ID NO: 677 - protein, 118 aa, Artificial Sequence
  430B3F1-VH
DVQLVESGGGLVQPGGSRKLSCAASGFTFSGFGMHWIRQTPEKGLEWVAYISSGGRPIYYADTVQGRFTISRDNPKNTLFLQMTSLRSEDTAMYFCARFYYGNSFDHWGQGTLVTISS

SEQ ID NO: 678 - protein, 113 aa, Artificial Sequence; identical to SEQ ID NO: 50
  430B3F1-VL

SEQ ID NO: 679 - protein, 118 aa, Artificial Sequence
  279E8B8-VH
QAYLQQSGAELVRSGASVKISCKASGYTFASHNMHWVKQTPGQGLEWIGYIYPGNGGTKYNQKFTGKATLSADTSSSTAYLQISSLTSEDSAVYFCARDYFGNSFVYWGQGTLVTVSA

SEQ ID NO: 680 - protein, 113 aa, Artificial Sequence
  279E8B8-VL
DIVMTQSPSSLTEKAGEKVSMRCKSSQSLLNSGNQKNYLTWYQQKPGQPPKLLIYWASTRESGVPDRFTGSGSGTDFTLTISSVQADDLAVYYCQNDYMYPFTFGAGTKLELK

What is claimed is:

1. A binding moiety that specifically binds to Claudin18.2, comprising:
   (1) VH CDR1, VH CDR2, and VH CDR3, comprising the amino acid sequences of SEQ ID NOs: 77, 102, and 124, respectively; and VL CDR1, CDR2, and CDR3 comprising the amino acid sequences of SEQ ID NOs: 141, 148, and 161, respectively;
   (2) VH CDR1, VH CDR2, and VH CDR3, comprising the amino acid sequences of SEQ ID NOs: 78, 103, and 125, respectively; and VL CDR1, CDR2, and CDR3 comprising the amino acid sequences of SEQ ID NOs: 136, 143, and 162, respectively;
   (3) VH CDR1, VH CDR2, and VH CDR3, comprising the amino acid sequences of SEQ ID NOs: 79, 104, and 126, respectively; and VL CDR1, CDR2, and CDR3 comprising the amino acid sequences of SEQ ID NOs: 136, 149, and 163, respectively;
   (4) VH CDR1, VH CDR2, and VH CDR3, comprising the amino acid sequences of SEQ ID NOs: 78, 105, and 127, respectively; and VL CDR1, CDR2, and CDR3 comprising the amino acid sequences of SEQ ID NOs: 142, 143, and 164, respectively; or
   (5) VH CDR1, VH CDR2, and VH CDR3, comprising the amino acid sequences of SEQ ID NOs: 209, 103 and 125, respectively; and VL CDR1, CDR2, and CDR3 comprising the amino acid sequences of SEQ ID NOs: 136, 143, and 162, respectively.

2. The binding moiety of claim 1, wherein the VH and the VL comprise
   (1) the amino acid sequences of SEQ ID NOs: 37 and 38, respectively;
   (2) the amino acid sequence of any one of SEQ ID NOs: 372-374 and the amino acid sequence of any one of SEQ ID NOs: 375-377, respectively;
   (3) the amino acid sequences of SEQ ID NOs: 39 and 40, respectively;
   (4) the amino acid sequences of SEQ ID NOs: 41 and 42, respectively;
   (5) the amino acid sequences of SEQ ID NOs: 43 and 44, respectively;
   (6) the amino acid sequence of any one of SEQ ID NOs: 355-362 and the amino acid sequence of either of SEQ ID NOs: 363 and 364, respectively;
   (7) the amino acid sequences of SEQ ID NOs: 521 and 522, respectively;
   (8) the amino acid sequences of SEQ ID NOs: 523 and 524, respectively; or
   (9) the amino acid sequences of SEQ ID NOs: 525 and 526, respectively.

3. The binding moiety of claim 1, which is a Fab, a Fab', a F (ab')$_2$, a Fv, a scFv, a (scFv)$_2$, or a full-length antibody.

4. The binding moiety of claim 1, which is a mouse, chimeric, humanized or human binding moiety.

5. A pharmaceutical composition comprising a therapeutically effective amount of the binding moiety of claim 1, and a pharmaceutically acceptable carrier.

6. A chimeric antigen receptor comprising:
   (a) an extracellular antigen binding domain comprising the binding moiety of claim 1, wherein the binding moiety is a single chain variable fragment (scFv);
   (b) a transmembrane domain; and
   (c) an intracellular signaling domain.

7. The chimeric antigen receptor of claim 6, comprising an amino acid sequence having at least 80%, 85%, 90%, 95% or 99% sequence identity to SEQ ID NO: 314, 315, or 304.

8. The chimeric antigen receptor of claim 7, comprising SEQ ID NO: 314, 315, or 304.

9. A nucleic acid encoding the chimeric antigen receptor of claim 6.

10. An engineered immune cell comprising the nucleic acid of claim 9.

11. The engineered immune cell of claim 10, wherein the engineered immune cell is a T cell.

12. A pharmaceutical composition comprising a therapeutically effective amount of the engineered immune cell of claim 10, and a pharmaceutically acceptable carrier.

13. A method of treating a Claudin18.2-expressing tumor or cancer in a subject in need thereof, comprising administering to the subject a therapeutically effective amount of the engineered immune cell of claim 10.

14. A pharmaceutical composition comprising a therapeutically effective amount of the chimeric antigen receptor of claim 6, and a pharmaceutically acceptable carrier.

15. A nucleic acid encoding the binding moiety of claim 1.

16. An expression vector comprising the nucleic acid of claim 15 and a regulatory element.

17. A host cell comprising the expression vector of claim 16.

18. A cell comprising the binding moiety of claim 1.

19. A method of treating a Claudin18.2-expressing tumor or cancer in a subject in need thereof, comprising administering to the subject a therapeutically effective amount of the binding moiety of claim 1.

20. The method of claim 19, wherein the Claudin18.2-expressing tumor or cancer is gastric, esophageal, gastroesophageal, pancreatic, ovarian, or lung tumor or cancer.

* * * * *